United States Patent
Goto et al.

(10) Patent No.: US 10,900,084 B2
(45) Date of Patent: Jan. 26, 2021

(54) METHOD FOR SUPPORTING DIAGNOSIS OF RISK OF COLORECTAL CANCER RECURRENCE, TREATMENT OF COLORECTAL CANCER, AND ADMINISTRATION OF ANTICANCER DRUG

(71) Applicant: SYSMEX CORPORATION, Kobe (JP)

(72) Inventors: Kengo Goto, Kobe (JP); Yuichiro Yoshida, Kobe (JP); Yasuhiro Otomo, Kobe (JP)

(73) Assignee: SYSMEX CORPORATION, Kobe (JP)

( * ) Notice: Subject to any disclaimer, the term of this patent is extended or adjusted under 35 U.S.C. 154(b) by 46 days.

(21) Appl. No.: 15/266,385

(22) Filed: Sep. 15, 2016

(65) Prior Publication Data
US 2017/0073770 A1 Mar. 16, 2017

(30) Foreign Application Priority Data
Sep. 16, 2015 (JP) ................................. 2015-183024

(51) Int. Cl.
*C12Q 1/68* (2018.01)
*C12Q 1/6886* (2018.01)

(52) U.S. Cl.
CPC ...... *C12Q 1/6886* (2013.01); *C12Q 2600/118* (2013.01); *C12Q 2600/158* (2013.01)

(58) Field of Classification Search
CPC ............ C12Q 1/6886; C12Q 2600/118; C12Q 2600/158
See application file for complete search history.

(56) References Cited

U.S. PATENT DOCUMENTS

2008/0058432 A1 3/2008 Wang et al.
2008/0227183 A1 9/2008 Ishihara et al.
(Continued)

FOREIGN PATENT DOCUMENTS

CN 1627268 A 6/2005
CN 1632709 A 6/2005
(Continued)

OTHER PUBLICATIONS

Haan, Genomic landscape of metastatic colorectal cancer, Nature Communications, 2014, 5:5457, pp. 1-12. (Year: 2014).*
(Continued)

*Primary Examiner* — Savitha M Rao
*Assistant Examiner* — Andrew P Lee
(74) *Attorney, Agent, or Firm* — Sughrue Mion, PLLC

(57) ABSTRACT

Disclosed is a method for supporting a diagnosis of a risk of colorectal cancer recurrence, including the steps of: performing a first measurement to measure the levels of expression of a plurality of genes selected from a first gene group present in a region from 18q21 to 18q23 on the long arm of chromosome 18 in a biological sample collected from a patient with colorectal cancer, a second measurement to measure the levels of expression of a plurality of genes selected from a second gene group present in a region from 20q11 to 20q13 on the long arm of chromosome 20, and a third measurement to measure the levels of expression of a plurality of genes selected from a third gene group including ANGPTL2, AXL, C1R, C1S, CALHM2, CTSK, DCN, EMP3, GREM1, ITGAV, KLHL5, MMP2, RAB34, SELM, SRGAP2P1, and VIM; and determining the risk of colorectal cancer recurrence of the patient based on the levels of expression measured in the measurement step.

16 Claims, 16 Drawing Sheets

Specification includes a Sequence Listing.

(56) References Cited

U.S. PATENT DOCUMENTS

| | | |
|---|---|---|
| 2009/0221609 A1 | 9/2009 | Del Rio et al. |
| 2011/0246413 A1 | 10/2011 | Shibayama et al. |
| 2012/0129200 A1 | 5/2012 | Ataman-Önal et al. |
| 2012/0185174 A1 | 7/2012 | Worzel et al. |
| 2013/0323748 A1 | 12/2013 | Ishihara et al. |
| 2014/0314662 A1 | 10/2014 | Batlle-Gomez et al. |

FOREIGN PATENT DOCUMENTS

| | | | |
|---|---|---|---|
| JP | 2008-220299 A | 9/2008 | |
| JP | 2009-528061 A | 8/2009 | |
| JP | 2011-209220 A | 10/2011 | |
| JP | 2012-522979 A | 9/2012 | |
| JP | 2013-111021 A | 6/2013 | |
| JP | 2014-503222 A | 2/2014 | |
| WO | 95/15521 A2 | 6/1995 | |
| WO | 2007/100859 A2 | 9/2007 | |
| WO | 2013/079309 A1 | 6/2013 | |
| WO | WO-2015017537 A2 * | 2/2015 | ........... C12Q 1/6886 |

OTHER PUBLICATIONS

Popovici, Molecular and clinicopathological evidence of heterogeneity in KRAS-mutant colon cancers, 2012, p. 1. (Year: 2012).*
Sarafidou, Chromosome 10, ELS, 2005, pp. 1-8. (Year: 2005).*
Meplan, The influence of selenium and selenoprotein gene variants on colorectal cancer risk, Mutagenesis, 2012, 27(2), pp. 177-186. (Year: 2012).*
Nannini, Gene expression profiling in colorectal cancer using microarray technologies: Results and perspectives, Cancer Treatment Reviews, 2009, 25, pp. 201-209. (Year: 2009).*
Sheffer, Michal, et al., "Association of survival and disease progression with chromosomal instability: A genomic exploration of colorectal cancer," Proceedings of the National Academy of Sciences, 2009, vol. 106, No. 17, pp. 7131-7136.
Japanese Office Action dated Jul. 30, 2019 in a counterpart Japanese patent application No. 2015-183024.
Japanese Office Action dated Jan. 7, 2020 in a counterpart Japanese patent application No. 2015-183024.

* cited by examiner

METHOD FOR SUPPORTING DIAGNOSIS OF RISK OF COLORECTAL CANCER RECURRENCE, TREATMENT OF COLORECTAL CANCER, AND ADMINISTRATION OF ANTICANCER DRUG

TECHNICAL FIELD

The present disclosure relates to a method for supporting a diagnosis of a risk of colorectal cancer recurrence. Particularly, the present disclosure relates to a method comprising: obtaining data on the levels of expression of genes belonging to predetermined gene groups concerning nucleic acids extracted from tissues of a patient with colorectal cancer; and supporting a diagnosis of a risk of colorectal cancer recurrence in the patient based on the obtained data on the levels of expression, a program, and a computer system.

BACKGROUND

Colorectal cancer is a generic term for tumors in the cecum, large intestine, and rectum. Similarly to many types of cancer, early detection is important to treat colorectal cancer. In the cancer treatment, anticancer drugs with powerful side effects may be used. In this case, patients are forced to bear heavy burdens. In order to reduce the patient's burdens, it is important for doctors to select the treatment optimal for the patients. For this purpose, the doctors need to accurately grasp the cancer progression stage, malignancy, and conditions of the patients.

An accurate prediction of patient's prognosis is important to improve the Quality of Life (QOL) of the prognosis. Dukes' classification (i.e., a histopathological procedure) is known as a method for predicting the prognosis of colorectal cancer. The Dukes' classification is widely used internationally, and includes a process of classifying into any of Dukes A, B, C, and D depending on the degree of cancer invasion. Since the Dukes' classification is performed by the doctors with naked eyes, some of the doctors are susceptible to error. There is also a problem such that a difference of diagnosis easily occurs because colorectal cancer tissues are obtained from different medical centers.

In recent years, studies for predicting the prognosis of cancer using gene markers have been performed by focusing on the increase-decrease rates of the levels of expression of certain genes. For example, US 2008/058432 A discloses a molecular analysis for predicting colorectal cancer recurrence in patients diagnosed as colorectal cancer or patients receiving colorectal cancer treatment. The technique disclosed in US 2008/058432 A is a method for predicting the prognosis of certain colorectal cancer recurrence. Consequently, the method cannot be used for all types of colorectal cancer.

An object of the present disclosure is to provide a method for supporting a diagnosis of a risk of colorectal cancer recurrence which is reliable on various cases of colorectal cancer, a program, and a computer system.

The present inventors have been dedicated to making repetitive studies and found out that colorectal cancer can be classified into three types by cluster analysis. Then, they have found out that the three types are associated with the prognosis of colorectal cancer and the result obtained is sufficiently stable, and completed the present disclosure.

SUMMARY OF THE INVENTION

According to the present disclosure, there is provided a method for supporting a diagnosis of a risk of colorectal cancer recurrence, including the steps of:

performing a first measurement to measure the levels of expression of a plurality of genes selected from a first gene group present in a region from 18q21 to 18q23 on the long arm of chromosome 18 in a biological sample collected from a patient with colorectal cancer, a second measurement to measure the levels of expression of a plurality of genes selected from a second gene group present in a region from 20q11 to 20q13 on the long arm of chromosome 20, and a third measurement to measure the levels of expression of a plurality of genes selected from a third gene group including ANGPTL2, AXL, C1R, C1S, CALHM2, CTSK, DCN, EMP3, GREM1, ITGAV, KLHL5, MMP2, RAB34, SELM, SRGAP2P1, and VIM; and determining the risk of colorectal cancer recurrence of the patient based on the levels of expression measured in the measurement step.

According to the present disclosure, there is provided a method for supporting a diagnosis of a risk of colorectal cancer recurrence which is reliable.

DETAILED DESCRIPTION OF THE PREFERRED EMBODIMENTS

Figure 1:
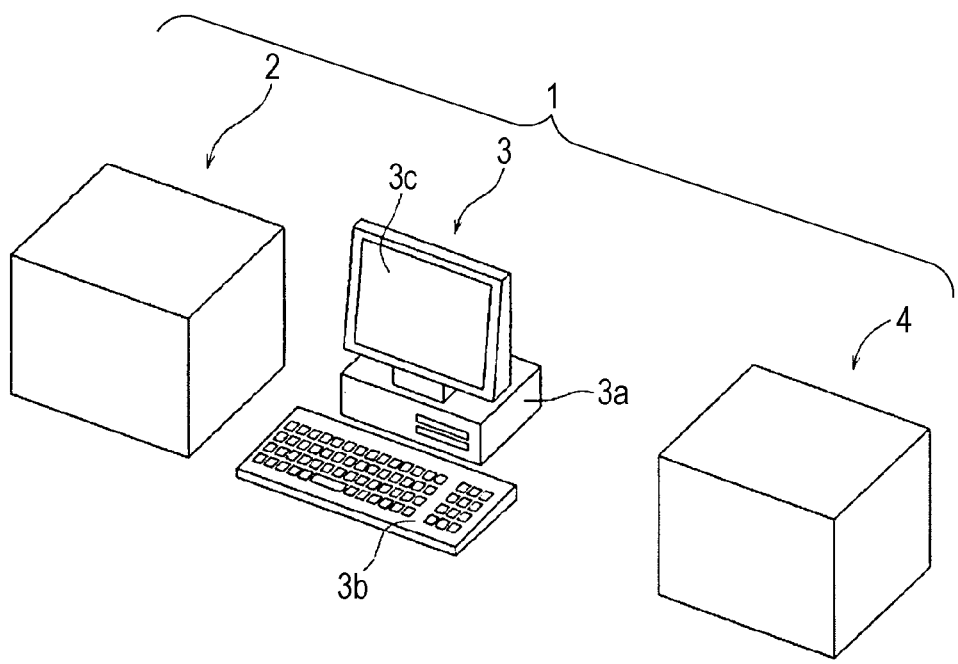
FIG. 1 is a schematic view showing an example of a diagnosis supporting apparatus which is used for a diagnosis supporting method of the present disclosure.

In the method for supporting a diagnosis of a risk of colorectal cancer recurrence of the embodiment (hereinafter referred to as "diagnosis supporting method"), the steps include performing a first measurement to measure the levels of expression of a plurality of genes selected from a first gene group present in a region from 18q21 to 18q23 on the long arm of chromosome 18 in a biological sample collected from a patient with colorectal cancer, a second measurement to measure the levels of expression of a plurality of genes selected from a second gene group present in a region from 20q11 to 20q13 on the long arm of chromosome 20, and a third measurement to measure the levels of expression of a plurality of genes selected from a third gene group including ANGPTL2, AXL, C1R, C1S, CALHM2, CTSK, DCN, EMP3, GREM1, ITGAV, KLHL5, MMP2, RAB34, SELM, SRGAP2P1, and VIM.

There is no particular limitation as to the "biological sample" so long as it is a biological sample containing nucleic acids derived from tumor cells of a patient with colorectal cancer (e.g., mRNA). For example, a clinical specimen may be used. Specific examples of the clinical specimen include blood, serum or tissues collected by surgery or biopsy. Further, a formalin-fixed paraffin-embedded (FFPE) sample of the tissue collected from a subject may be used as the biological sample. Usable "biological samples" may be biological samples collected from colorectal cancer patients without receiving adjuvant chemotherapy, among patients with colorectal cancer. The use of biological samples collected from colorectal cancer patients without receiving adjuvant chemotherapy enables the risk of colorectal cancer recurrence to be determined with higher accuracy.

Adjuvant chemotherapy is an additional chemotherapy usually given after surgery where all detectable disease has been removed, but where there remains a statistical risk of relapse due to occult disease. The adjuvant, chemotherapy for colorectal cancer is usually used 5-fluorouracil anticancer drugs and/or oxaliplatin.

The method of the embodiment may include a step of extracting DNA from a biological sample before the measurement step. The extraction of DNA from the biological sample may be carried out by any known method in the art. For example, a DNA extract may be obtained by a process including centrifuging the biological sample to precipitate DNA-containing cells, physically or chemically destroying the cells, and removing the cell debris. The operation may also be carried out using a commercially available DNA extraction kit or the like.

As used herein, the term "the first gene group" is a general term for genes present in a region from 18q21 to 18q23 on the long arm of chromosome 18. Specifically, the first gene group includes genes represented by the following gene symbols: C18orf22 (chromosome 18 open reading frame 22), C18orf55 (chromosome 18 open reading frame 55), CCDC68 (coiled-coil domain containing 68), CNDP2 (CNDP dipeptidase 2 (metallopeptidase M20 family)), CYB5A (cytochrome b5 type A (microsomal)), LOC400657 (hypothetical LOC400657), LOC440498 (heat shock factor binding protein 1-like), MBD2 (methyl-CpG binding domain protein 2), MBP (myelin basic protein), MYO5B (myosin VB), NARS (asparaginyl-tRNA synthetase), PQLC1 (PQ loop repeat containing 1), RTTN (Rotatin), SEC11C (SEC11 homolog C (*S. cerevisiae*)), SOCS6 (suppressor of cytokine signaling 6), TNFRSF11A (tumor necrosisfactor receptor superfamily, member 11a, NFKB activator), TXNL1 (thioredoxin-like 1), TXNL4A (thioredoxin-like 4A), VPS4B (vacuolar protein sorting 4 homolog B (*S. cerevisiae*)), and ZNF407 (zinc finger protein 407).

As used herein, the term "the second gene group" is a general term for genes present in a region from 20q11 to 20q13 on the long arm of chromosome 20. Specifically, the second gene group includes genes represented by the following gene symbols: ASXL1 (additional sex combs like 1 (*Drosophila*)), C20orf112 (chromosome 20open reading frame 112), C20orf177 (chromosome 20 open reading frame 177), CHMP4B (chromatin modifying protein 4B), COMMD7 (COMM domain containing 7), CPNE1 (copine I), DIDO1 (death inducer-obliterator 1), DNAJC5 (DnaJ (Hsp40) homolog, subfamily C, member 5), KIF3B (kinesin family member 3B), NCOA6 (nuclear receptor coactivator 6), PHF20 (PHD finger protein 20), PIGU (phosphatidylinositol glycan anchor biosynthesis, class U), PLAGL2 (pleiomorphic adenoma gene-like2), POFUT1 (protein O-fucosyltransferase 1), PPP1R3D (protein phosphatase 1, regulatory (inhibitor) subunit 3D), PTPN1 (protein tyrosine phosphatase, non-receptor type 1), RBM39 (RNA binding motif protein 39), TAF4 (TAF4 RNA polymeraseII, TATA box binding protein (TBP)-associated factor, 135 kDa), and TCFL5 (transcription factor-like 5 (basic helix-loop-helix)).

As used herein, the term "the third gene group" is a general term for genes including genes which are biologically referred to as "stroma-related genes" or "EMT-related genes". Specifically, the third gene group includes genes represented by the following gene symbols: ANGPTL2 (angiopoietin-like 2), AXL (AXL receptor tyrosine kinase), C1R (complement component 1, r subcomponent), C1S (complement component 1, s subcomponent), CALHM2 (calcium homeostasis modulator 2), CTSK (cathepsin K), DCN (Decorin), EMP3 (epithelial membrane protein 3), GREM1 (gremlin 1, cysteine knot superfamily, homolog (*Xenopus laevis*)), ITGAV (integrin, alpha V (vitronectin receptor, alpha polypeptide, antigen CD51)), KLHL5 (kelch-like 5 (*Drosophila*)), MMP2 (matrix metallopeptidase 2 (gelatinase A, 72 kDa gelatinase, 72 kDa type IV collagenase)), RAB34 (RAB34, member RAS oncogene family), SELM (selenoprotein M), SRGAP2P1 (SLIT-ROBO Rho GTPase activating protein 2 pseudogene1), and VIM (Vimentin). As used herein, the third gene group may be referred to as "stroma-related gene group".

The diagnosis supporting method of the embodiment determines the risk of colorectal cancer recurrence using the three gene groups.

As used herein, the term "transcription products of genes" means products obtained by the transcription of the genes, which include ribonucleic acid (RNA), specifically, messenger RNA (mRNA).

As used herein, the term "the level of expression of transcription products of genes" means the amounts of gene transcription products in the biological sample or the amounts of substances that reflect the amounts of the gene transcription products in the biological sample. Therefore, the diagnosis supporting method of the present disclosure may measure the amounts of gene transcription products (mRNAs) or the amounts of complementary deoxyribonucleic acids (cDNAs) or complementary ribonucleic acids (cRNAs) derived from mRNAs. In general, the amount of mRNA in a biological sample is very small. Therefore, the amount of cDNA or cRNA derived therefrom by reverse transcription or in vitro transcription (IVT) is preferably measured.

The gene transcription products may be extracted from the biological sample by an RNA extraction method known in the art. For example, an RNA extract may be obtained by a process including centrifuging the biological sample to precipitate RNA-containing cells, physically or enzymatically destroying the cells, and removing the cell debris. The RNA extraction may also be performed using a commercially available RNA extraction kit or the like.

A treatment for removing a contaminant from the gene transcription product extract obtained as described above may also be performed. Such a contaminant, which is globin mRNA when the biological sample is blood, is derived from the biological sample and preferably absent in the measurement of the levels of expression of the gene transcription products.

The resulting gene transcription product extract is measured for the levels of expression of a plurality (two or more) of genes selected from the first to third gene groups. In particular embodiments, at least 5 or more of the genes of each of the groups are measured; In further particular embodiments, at least 6, 7, 8, 9, 10, 11, 12, 13, 14, 15, 16 or where appropriate at at least 17, 18, 19, 20, such as all of the genes are measured. The exact number of the plurality of genes measured for each gene group need not be the same. In particular embodiments, for each group, the levels of expression of five or more of the genes are measured, whereby biological variations or measurement errors caused when the expression of predetermined genes is unexpectedly high or low can be reduced. Accordingly, the diagnosis of a risk of recurrence can be supported with higher reliability.

The levels of expression of the genes may be measured by any known method in itself. In the method for supporting a diagnosis of a risk of colorectal cancer recurrence of the embodiment, the measurement is preferably carried out by a nucleic acid chip assay, i.e., a so-called microarray assay.

When the levels of expression of the gene transcription products are measured using a microarray, a process may include: bringing cDNAs or cRNAs, which are prepared from the gene transcription product extract or the gene transcription products, into contact with about 20 to 25 mer nucleic acid probes fixed on a substrate; and measuring the change in fluorescence, coloring, current, or any other index to determine the presence or absence of hybridization, so that the levels of expression of the target gene transcription products can be determined.

At least one nucleic acid probe may be used for one gene transcription product, and a plurality of probes may be used depending on the length of the gene transcription product. The probe sequence may be appropriately determined by a person skilled in the art according to the sequence of the gene transcription product to be measured.

For example, GeneChip System available from Affymetrix, Inc. may be used in the method of measuring the levels of expression of the gene transcription products using a nucleic acid chip.

When a nucleic acid chip is used, the gene transcription products or cDNAs or cRNAs thereof may be fragmented so that the hybridization with the nucleic acid probes can be facilitated. The fragmentation may be performed by any known method in the art, such as a method using nuclease such as ribonuclease or deoxyribonuclease.

In the measurement step, measurement of the levels of expression of the plurality of genes may be performed respectively for each gene, or may be performed simultaneously for some or all of the genes. For example, when a nucleic acid chip is used, the first measurement, the second measurement, and the third measurement can be performed simultaneously on a single nucleic acid chip.

The amounts of the gene transcription products or cDNAs or cRNAs thereof to be in contact with the nucleic acid probes on the nucleic acid chip may generally be from about 5 µg to 20 µg. The contact conditions are generally 45° C. for about 16 hours.

Whether or not and how much the gene transcription products or cDNAs or cRNAs thereof hybridize with the nucleic acid probes can be detected using a fluorescent substance or a dye or based on a hybridization-induced change in the amount of current flowing on the nucleic acid chip.

When the hybridization is measured by the detection of a fluorescent substance or a dye, the gene transcription products or cDNAs or cRNAs thereof are preferably labeled with a labeling substance for the detection of the fluorescent substance or the dye. Examples of the labeling substance may include labeling substances generally used in the art. In general, biotinylated nucleotide or biotinylated ribonucleotide may be mixed as a nucleotide or ribonucleotide substrate in the synthesis of cDNAs or cRNAs so that biotin-labeled cDNAs or cRNAs can be obtained. The biotin-labeled cDNAs or cRNAs can be coupled to avidin or streptavidin, which is a binding partner to biotin, on the nucleic acid chip. The binding of avidin or streptavidin to an appropriate fluorescent substance or dye makes it possible to detect the hybridization. Examples of the fluorescent substance include fluorescein isothiocyanate (FITC), green fluorescent protein (GFP), luciferin, and phycoerythrin. In general, a phycoerythrin-streptavidin conjugate is commercially available and therefore conveniently used.

Alternatively, a labeled antibody to avidin or streptavidin is brought into contact with avidin or streptavidin so that the fluorescent substance or dye of the labeled antibody can be detected.

There is no particular limitation as to the levels of expression of the gene transcription products obtained in this step so long as they may be values that relatively indicate the amount of each gene transcription product in the biological sample. When the measurement is performed using the nucleic acid chip, the levels of expression may be signals obtained from the nucleic acid chip, which are based on the intensity of fluorescence, the intensity of coloring, the amount of current, or the like.

Such signals may be measured using a nucleic acid chip analyzer.

Data on the levels of expression of genes obtained from biological samples collected from a plurality of patients with colorectal cancer can be clustered by clustering. The clustering process can be performed by, for example, the method of distance of closest approach. The method of distance of closest approach is a hierarchy clustering method including the steps of: calculating a distance between elements and sequentially binding the elements close to each other in order to perform a step-by-step clustering. In the embodiment, a "biological sample" corresponds to an "element". A "difference between the levels of expression of genes" between the elements" corresponds to a "distance".

In the determination step, various analysis methods can be employed.

For example, the determination is performed based on comparison of the level of expression of genes selected from the first gene group in the biological sample to a first standard value, comparison of the level of expression of genes selected from the second gene group in the biological sample to a second standard value, and comparison of the level of expression of genes selected from the third gene group in the biological sample to a third standard value of the genes. In this disclosure, a standard value is a threshold value or cut-off value in other words. The level of expression can be calculated from levels of expression of genes. The level of expression can be an average, a median value or a mode value of levels of expression of genes.

Subsequently, in the determination step of the embodiment, the risk of colorectal cancer recurrence is determined based on the data on the level of expression of genes obtained in the measurement step. In particular embodiments, the risk of colorectal cancer recurrence is determined based on the data of the levels of expression only of the plurality of genes of the gene groups identified above.

In a preferred embodiment of the present invention, the risk of recurrence is determined to be high when the level of expression of genes selected from the third gene group is more than or equal to a standard value regardless of the level of expression of genes selected from the first and second gene groups in the determination step.

In other words, the risk of recurrence is determined to be high when the level of expression of genes selected from the third gene group is more than or equal to a standard value, even if the level of expression of genes selected from the first and second gene groups is more than or equal to a standard value, or is lower than a standard value.

In a preferred embodiment of the present invention, the risk of recurrence is determined to be medium when the level of expression of genes selected from the third gene group is lower than a standard values and the level of expression of genes selected from the first gene group is lower than a standard value regardless of the level of expression of genes selected from the second gene group in the determination step.

In other words, the risk of recurrence is determined to be medium when the level of expression of genes selected from the third gene group is lower than a standard value and the level of expression of genes selected from the first gene group is lower than a standard value, even if the level of expression of genes selected from the second gene group is more than or equal to a standard value, or are lower than a standard value.

In a preferred embodiment of the present invention, the risk of recurrence is determined to be medium when the level of expression of genes selected from the third gene group is lower than a standard value, the level of expression of genes selected from the first group is more than or equal to the standard values of the genes, and the level of expression of genes selected from the second gene group is more than or equal to a standard value in the determination step.

In a preferred embodiment of the present invention, there is provided a method for supporting a diagnosis of a risk of colorectal cancer recurrence, wherein the risk of recurrence is determined to be low when the level of expression of genes selected from the third gene group is lower than the standard values of the genes, the level of expression of genes selected from the first gene group is more than or equal to the standard values of the genes, and the level of expression of genes selected from the second gene group is lower than the standard values of the genes in the determination step.

In the embodiments described above, the "standard value" that is set for each gene group is a value that can determine if the genes in the gene group are overexpressed. The "standard value" for the first gene group, for example, is obtained as follows. First, in a particular patient group, the average value of the levels of expression of genes is calculated. Concretely, by measuring the levels of expression of C18orf22 in each patient in the patient group and then dividing the sum of the levels of expression by the number of the patients, the average value of the levels of expression of C18orf22 in the patient group can be obtained. In the same manner, average values for the other genes in the first gene group are obtained. By dividing the sum of the average values of the levels of expression of the genes by the number of the genes, the average value for the first gene group in the particular patient group can be obtained. The resulting average value can be used as the "standard value". In the same manner, the "standard values" for the second gene group and the third gene group can also be obtained.

Although the standard value exemplified above is the "average value", a value other than the average value, such as the median value or the mode value, may be used instead.

The standard value is preferably obtained before the measurement step and the determination step.

In a preferred embodiment of the present disclosure, the sum of the levels of expression of the genes in a biological sample is divided by the number of the genes to give the average value of the levels of expression of the genes in the biological sample, and the resulting average value of the levels of expression of the genes in the biological sample is compared to the standard value described above.

As used herein, the term "standard value" may be appropriately set from the accumulated data on the levels of expression of genes selected from the first to third gene groups in a patient with colorectal cancer. For example, the standard value may be an average value on the levels of expression of genes in a plurality of patients. As a number (n) of target patients is increased, the average values of the data on the levels of expression are converged. Thus, it is possible to reduce the variations in the average values.

In another embodiment of the present disclosure, the risk of recurrence is determined based on an expression pattern of genes in a biological sample and expression patterns of genes in patient groups. In this method, instead of establishing a plurality of "gene groups", a plurality of patient groups are established according to risks of recurrence. Specifically, a group of patients are classified into three groups, namely, a patient group to be determined to have a high risk of recurrence (hereinafter, also called a "high-risk group"), a patient group to be determined to have a medium risk of recurrence (hereinafter, also called a "medium-risk group"), and a patient group to be determined to have a low risk of recurrence (hereinafter, also called a "low-risk group").

The levels of expression of genes under analysis in samples from each patient group are obtained, and then the average values are calculated. When the high-risk group has 100 patients and in order to calculate the average value of the levels of expression of C18orf22, for example, the sum of the levels of expression of C18orf22 in the 100 patients is divided by 100 and the resulting value is the average value of the levels of expression of C18orf22 in the high-risk group. In the same manner, the average values of the levels of expression of C18orf22 in the medium-risk group and the low-risk group are calculated. In the embodiment, analysis is performed on a plurality of genes and therefore the average value of the levels of expression of each of the plurality of genes is calculated. In this embodiment, average value of average values is not calculated. A data set that is composed of the average values of the levels of expression thus obtained for the high-risk group is referred to as an expression pattern for the high-risk group, a data set that is composed of the average values of the levels of expression thus obtained for the medium-risk group is referred to as an expression pattern for the medium-risk group, and a data set that is composed of the average values of the levels of expression thus obtained for the low-risk group is referred to as an expression pattern for the low-risk group. If 55 genes are analyzed, the expression pattern for each risk group includes 55 values.

The expression patterns for the risk groups are obtained before measurement of Expression of genes in the biological sample and determination of the risk of recurrence.

Then, the levels of expression of genes in the biological sample are measured. A data set that is composed of the levels of expression of the genes measured in the measurement step is referred to as an expression pattern for the biological sample. If 55 genes are analyzed, the expression pattern for the biological sample includes 55 values.

The correlation between the expression pattern for the genes in the biological sample and the expression pattern for each risk group is analyzed. A risk group that exhibits the highest correlation with the expression pattern for the biological sample is identified. The risk of recurrence for the biological sample is determined to be the risk of recurrence corresponding to the risk group thus identified. In the case where the levels of expression of the genes in the biological sample exhibit the highest correlation with the high-risk group, for example, the biological sample is determined to have a high risk of recurrence.

In the analysis of correlation above, various methods can be employed. Determination of the risk of recurrence can be made, for example, by calculating a correlation coefficient between the expression pattern for the biological sample and the expression pattern for the high-risk group, a correlation coefficient between the expression pattern for the biological sample and the expression pattern for the medium-risk group, and a correlation coefficient between the expression pattern for the biological sample and the expression pattern for the low-risk group, comparing the resulting correlation coefficients with each other, and classifying the biological sample into the risk group that exhibits the highest correlation coefficient. In the case where the correlation coefficient with the expression pattern for the high-risk group is the highest, for example, the biological sample is classified into the high-risk group and determined to have a high risk of recurrence.

Calculation of the correlation coefficients can be performed by a known method. For example, the correlation coefficients can be calculated according to the Spearman's rank correlation, Pearson product-moment correlation, Kendall's rank correlation, or the like.

As the method of analyzing correlation with the risk groups, cluster analysis can also be employed. The analysis can be performed as follows, for example.

The average values of the levels of expression of genes in each of a plurality of patients are obtained in advance (at this point, classification into a high-risk group, a medium-risk group, and a low-risk group has not yet been performed). In the measurement step, the levels of expression of genes in a biological sample are measured. Cluster analysis is performed to classify the patients and the biological sample into a high-risk group, a medium-risk group, and a low-risk group based on the levels of expression of the genes in the patients and the levels of expression of the genes in the biological sample. Based on the risk group into which the biological sample is classified, the risk of recurrence for the biological sample can be determined.

Instead of the analysis techniques described above, linear discriminant analysis, support vector machine, or the like can be used for determination.

In any one of the various analysis methods described above, determination will be made as follows.

When the level of expression of genes belonging to the third gene group is high, the risk of recurrence is determined to be high.

When the level of expression of genes belonging to the first gene group is low and the levels of expression of genes belonging to the third gene group are low, the risk of recurrence is determined to be medium.

When the level of expression of genes belonging to the first gene group is high, the level of expression of genes belonging to the second gene group is high, and the level of expression of genes belonging to the third gene group is low, the risk of recurrence is determined to be medium.

When the level of expression of genes belonging to the first gene group is high, the level of expression of genes belonging to the second gene group is low, and the level of expression of genes belonging to the third gene group is low, the risk of recurrence is determined to be low.

In other words, up-regulated expression of genes belonging to the third gene group indicates high risk, down-regulated expression of genes belonging to the first gene group and down-regulated expression of genes belonging to the third gene group indicates medium risk, and up-regulated expression of genes belonging to the first gene group and down-regulated expression of genes belonging to the third gene group indicates medium risk, and up-regulated expression of genes belonging to the first gene group, down-regulated expression of genes belonging to the second gene group, and down-regulated expression of genes belonging to the third gene group indicates low risk.

In a more preferred embodiment of the present disclosure, the risk of recurrence is determined to be high when the group determined to have a medium risk of recurrence has a KRAS gene mutation, and the risk of recurrence is determined to be low when the group does not have the KRAS gene mutation.

The KRAS gene is a type of ras oncogene, which is present at a position of 25.36 Mb to 25.4 Mb on chromosome 12. The gene transmits the signal of epidermal growth factor receptor (EGFR) to the nucleus and has a function to facilitate proliferation of cells. The base sequence of cDNA of KRAS is represented as SEQ ID NO: 56. This base sequence is known as the accession number: AF493917 in the human genome database GenBank.

The KRAS gene mutation indicates preferably a mutation that occurs in the base sequence GGTGGC corresponding to the 12th and 13th codons located at exon 2 of the gene (bases 34 to 39) or a mutation that occurs in the base sequence CAA corresponding to the 61st codon located at exon 3 (bases 182 to 184).

There is no particular limitation as to the method of measuring the presence of KRAS mutation and the method may be carried out by any method known by a person skilled in the art. In the embodiment, the measurement of the presence of KRAS mutation may be performed using sequence analysis.

There is no particular limitation as to the KRAS gene mutation. When any one of the bases in the above codons is mutated, the presence of mutation can be determined. In the embodiment, it is preferable that a target is a mutation of the base sequence that results in the mutation of the amino acid sequence of the KRAS protein (i.e., mutations other than silent mutations, for example, a missense mutation, nonsense mutation, and frame shift mutation). The type of mutation is considered to be a substitution, deficiency, deletion or addition of nucleotides. In the present embodiment, the substitution is preferred. Specific examples of such substitution include the Substitution of G34 by A, the Substitution of G35 by A, C or T, the substitution of G38 by A, the substitution of C182 by A, and the substitution of A184 by C or T.

As described above, the presence of KRAS mutation is added to the determination criteria so that the medium-risk group can be classified into a high-risk group and a low-risk group and the whole can be classified into the two high and low groups. Accordingly, the medium-risk group can be classified into either the high group or the low group, and information useful to many cases can be provided.

The present disclosure includes a computer program product for causing a computer to execute processing of determining a risk of colorectal cancer recurrence in a patient. Examples of the computer program product include downloadable programs via the Internet and media that store the programs.

For example, programs for causing a computer to execute the following processing are exemplified.

The processing of receiving, in a biological sample collected from a patient with colorectal cancer, the levels of expression of a plurality of genes selected from a first gene group present in a region from 18q21 to 18q23 on the long arm of chromosome 18, the levels of expression of a plurality of genes selected from a second gene group present in a region from 20q11 to 20q13 on the long arm of chromosome 20, and the levels of expression of a plurality of genes selected from a third gene group including ANGPTL2, AXL, C1R, C1S, CALHM2, CTSK, DCN, EMP3, GREM1, ITGAV, KLHL5, MMP2, RAB34, SELM, SRGAP2P1, and VIM; and the processing of determining the risk of colorectal cancer recurrence in the patient based on the received levels of expression.

Hereinafter, a preferred embodiment of the apparatus to execute the method of the embodiment will be described with reference to the drawings. However, the present disclosure is not limited only to this embodiment. FIG. 1 is a schematic view showing an example of a diagnosis supporting apparatus which is used to determine a risk of colorectal cancer recurrence in a patient. A diagnosis supporting apparatus 1 shown in FIG. 1 includes a measurement device 2 and a computer system 3 connected to the measurement device 2.

In the embodiment, the measurement device 2 is a measurement device for the nucleic acid chip. The measurement device 2 obtains the levels of expression of genes themselves and information on the levels of expression of genes, such as hue of the colored fluorescence from the nucleic acid chip or fluorescence intensity. When a biological sample collected from a patient with colorectal cancer is set in the measurement device 2, the measurement device 2 obtains information on the levels of expression of genes in the biological sample and transmits the obtained information to the computer system 3.

When the specimen determined to have a medium risk is determined whether the risk of colorectal cancer recurrence is high or low, the diagnosis supporting apparatus 1 further includes a mutation measuring device 4, in addition to the computer system 3 connected to the measurement device 2 and the measurement device 2.

In the embodiment, the mutation measuring device 4 obtains information on the presence of the KRAS gene mutation in the biological sample. When a biological sample collected from a patient with colorectal cancer is set in the mutation measuring device 4, the mutation measuring device 4 obtains information on the presence of the KRAS gene mutation in the biological sample and transmits the obtained information to the computer system 3.

The computer system 3 includes a computer main body 3a, an input unit 3b including a keyboard and a mouse, and a display unit 3c including an LCD or CRT to display specimen information, determination result or the like thereon. The computer system 3 receives the information on the levels of expression of genes and the information on the presence of the KRAS gene mutation (if necessary) from the measurement device 2 and the mutation measuring device 4. Then, the computer system 3 executes a program for determining a risk of colorectal cancer recurrence in a subject based on the information. The data "classification into two groups is necessary" described below may be input from the input unit 3b.

Figure 2:
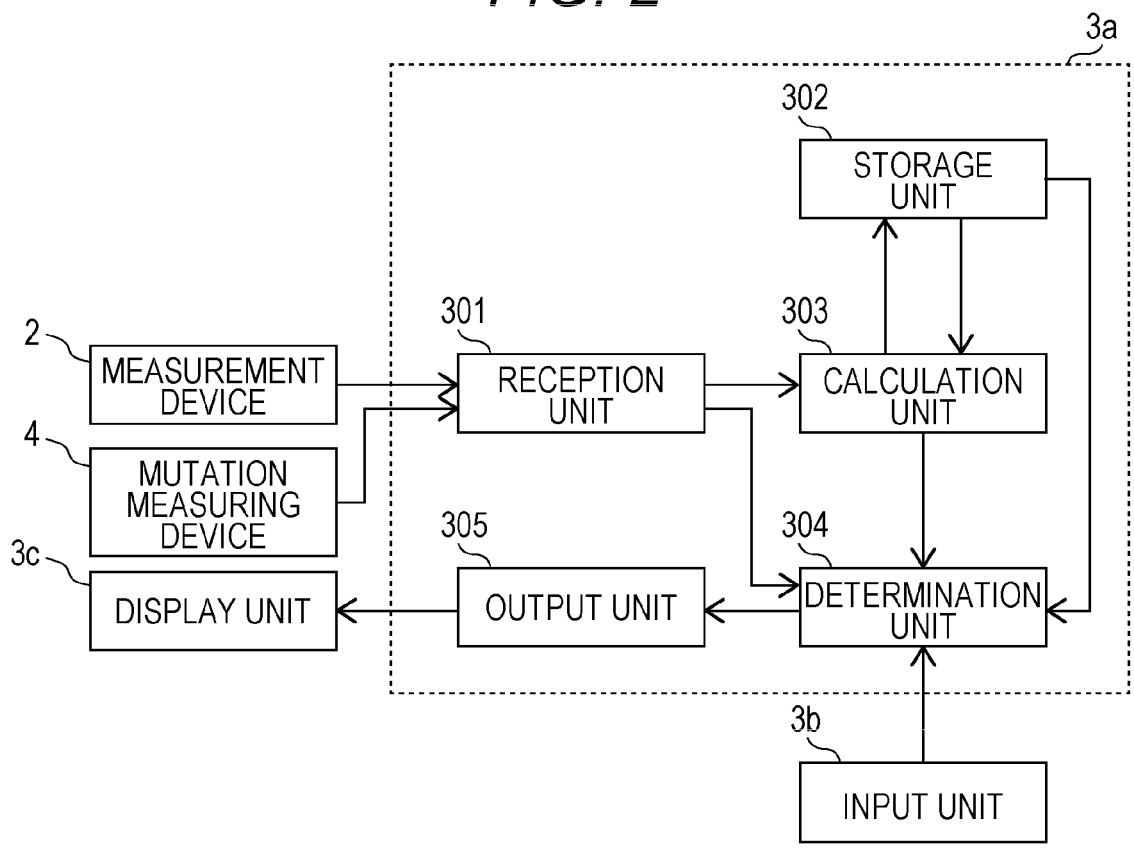
FIG. 2 is a block diagram showing a functional configuration of software of the diagnosis supporting apparatus.

FIG. 2 is a block diagram showing a functional block of the software of the computer main body 3a of the diagnosis supporting apparatus 1. As shown in FIG. 2, the computer includes a reception unit 301, a storage unit 302, a calculation unit 303, a determination unit 304, and an output unit 305. The reception unit 301 is communicably connected to the measurement device 2 and the mutation measuring device 4 (if necessary) via the network. The information necessary to execute the determination of the risk of colorectal cancer recurrence, specifically the information on whether or not the measurement of the presence of the KRAS gene mutation in the specimen determined to have a medium risk (classification into two groups) is performed, can be input to the determination unit 304 through the input unit 3b.

The reception unit 301 receives the information transmitted from the measurement device 2 and the mutation measuring device 4. The storage unit 302 stores standard values necessary for determination, formulae for calculating the levels of expression of genes, and processing programs. The calculation unit 303 calculates the levels of expression of genes according to the stored formulae using the information obtained by the reception unit 301. The determination unit 304 determines whether the levels of expression of genes which have been obtained by the reception unit 301 or calculated by the calculation unit 303 are more than or equal to the standard values stored in the storage unit 302. The output unit 305 outputs the determination result by the determination unit 304 (as the determination result of the risk of colorectal cancer recurrence in the subject) to the display unit 3c.

When the specimen determined to have a medium risk is determined whether the risk of colorectal cancer recurrence is high or low, the reception unit 301 obtains the information transmitted from the mutation measuring device 4, in addition to the information transmitted from the measurement device 2. The storage unit 302 stores nonmutant sequences in the KRAS gene, in addition to standard values necessary for determination, and formulae for calculating the levels of expression of genes. The calculation unit 303 calculates the levels of expression of genes according to the stored formulae using the information obtained by the reception unit 301. The determination unit 304 determines whether the levels of expression of genes which have been obtained by the reception unit 301 or calculated by the calculation unit 303 are more than or equal to the standard values stored in the storage unit 302. Additionally, the determination unit 304 determines the presence of the KRAS gene mutation based on whether or not the sequences of the KRAS gene obtained by the reception unit 301 match the nonmutant sequences in the KRAS gene stored in the storage unit 302. The output unit 305 outputs the determination result by the determination unit 304 (as the determination result of the risk of colorectal cancer recurrence in the subject) to the display unit 3c.

Figure 3:
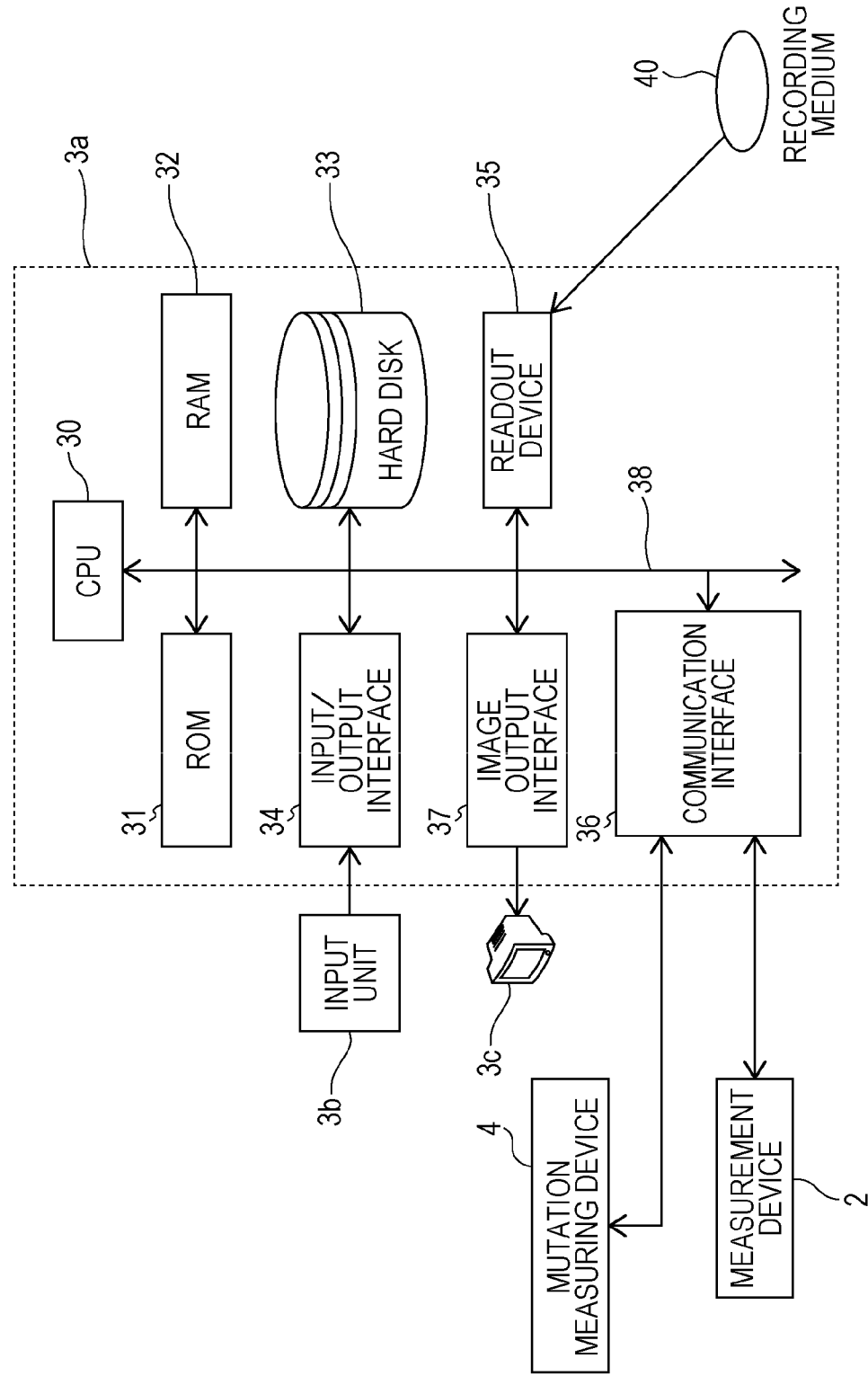
FIG. 3 is a block diagram showing a configuration of hardware of the diagnosis supporting apparatus.

FIG. 3 is a block diagram showing the configuration of the hardware of the computer main body 3a shown in FIG. 2. As shown in FIG. 3, the computer main body 3a includes a CPU (Central Processing Unit) 30, a ROM (Read Only Memory) 31, a RAM (Random Access Memory) 32, a hard disk 33, an input/output interface 34, a readout device 35, a communication interface 36, and an image output interface 37. The CPU 30, the ROM 31, the RAM 32, the hard disk 33, the input/output interface 34, the readout device 35, the communication interface 36, and the image output interface 37 are connected to one another through a bus 38 to allow data communication.

The CPU 30 can execute the computer program stored in the ROM 31 and the computer program loaded on the RAM 32. The CPU 30 executes the computer programs, whereby each of the functions shown in FIG. 2 is executed. Accordingly, the computer system 3 functions as a diagnosis supporting apparatus for determining a risk of colorectal cancer recurrence in a subject.

The ROM 31 is configured to include a mask ROM, PROM, EPROM, EEPROM or the like. The ROM 31 stores the computer program to be executed by the CPU 30 as described above and the data used for the execution.

The RAM 32 is configured to include SRAM, DRAM or the like. The RAM 32 is used to read out the computer programs stored in the ROM 31 and the hard disk 33. When these computer programs are executed, the RAM 32 is used as a work area of the CPU 30.

Computer programs to be executed by the CPU 30, such as an operating system and an application program (computer program for determining a risk of colorectal cancer recurrence in a subject), and data to be used for the execution of the computer program are installed on the hard disk 33.

The readout device 35 is configured to include a flexible disk drive, a CD-ROM drive, a DVD-ROM drive, and the like. The readout device 35 can read out the computer program or data stored on a portable recording medium 40.

For example, the input/output interface 34 is configured to include a serial interface such as USB, IEEE 1394 or RS-232C, a parallel interface such as SCSI, IDE or IEEE 1284, and an analog interface including a D/A converter, an A/D converter or the like. The input unit 3b including a keyboard and a mouse is connected to the input/output interface 34. An operator can input various instructions to the computer main body 3a using the input unit 3b.

The communication interface 36 is, for example, an Ethernet (registered trademark) interface or the like. The computer main body 3a can send printing data to a printer via the communication interface 36.

The image output interface 37 is connected to the display unit 3c including LCD, CRT or the like. Thus, an image signal corresponding to the image data from the CPU 30 can be output on the display unit 3c. The display unit 3c displays an image (on the screen) according to the image signal input.

Figure 4:
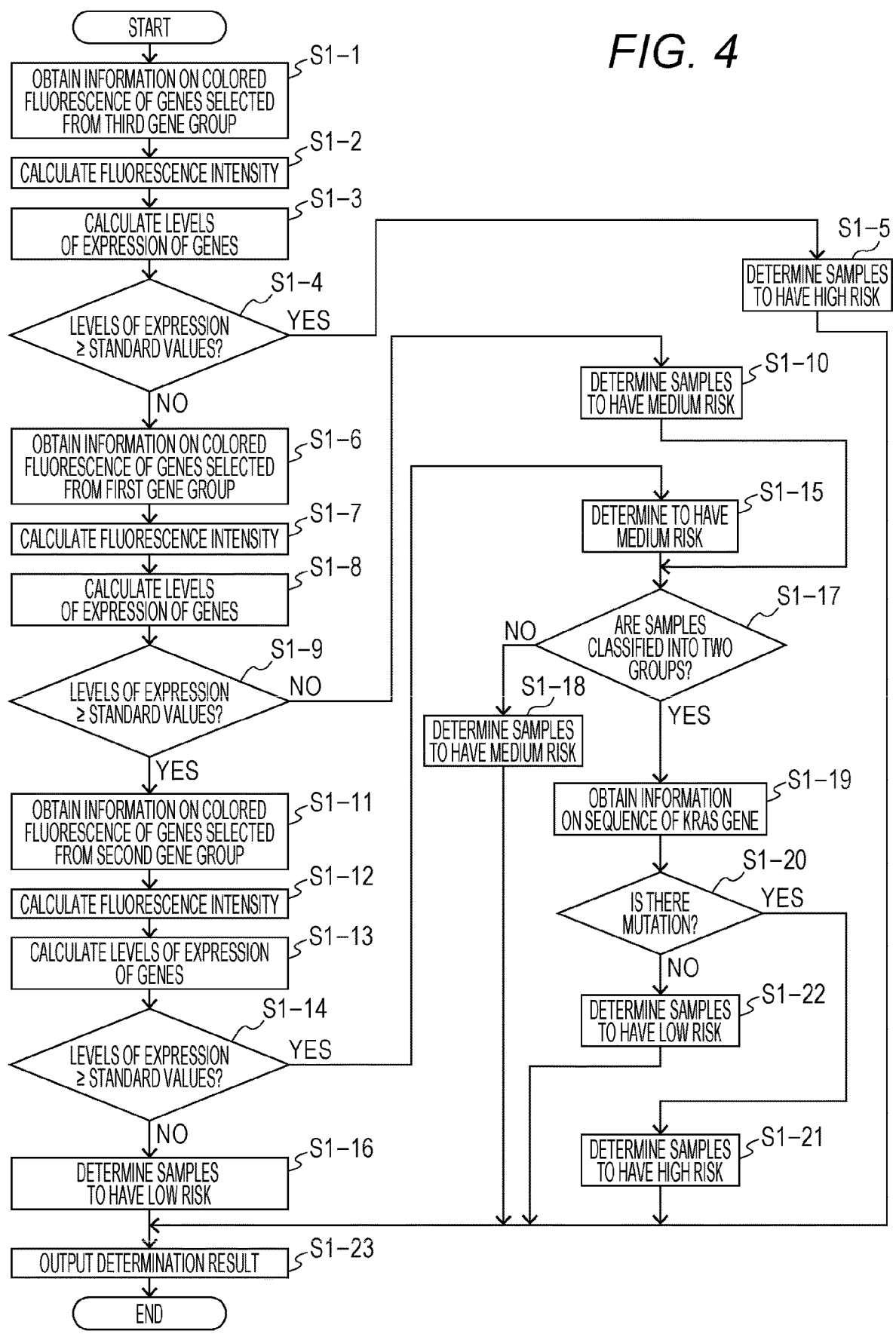
FIG. 4 is a flow chart showing operation of the diagnosis supporting apparatus.

Subsequently, the procedure of determining a risk of colorectal cancer recurrence in a subject by the diagnosis supporting apparatus 1 will be described. FIG. 4 is a flowchart of determining the risk of colorectal cancer recurrence. An example to be described herein is the case where the fluorescence intensity is calculated from the information on the colored fluorescence obtained by using a biological sample from a subject, the levels of expression of genes are calculated from the obtained fluorescence intensity, and it is determined whether the obtained levels of expression are more than or equal to the standard values. However, the present disclosure is not limited only to this embodiment.

First, the reception unit 301 of the diagnosis supporting apparatus 1 obtains information on the colored fluorescence regarding the levels of expression of genes selected from the third gene group from the measurement device 2 (step S1-1). Next, the calculation unit 303 calculates the fluorescence intensity from the obtained information and transmits it to the storage unit 302 (step S1-2). The calculation unit 303 calculates the levels of expression of genes according to the stored formulae using the stored fluorescence intensity (step S1-3).

Thereafter, the determination unit 304 determines whether the levels of expression calculated in step S1-3 are more than or equal to the standard values stored in the storage unit 302 (step S1-4). When the levels of expression are more than or equal to the standard values, the routine proceeds to step S1-5. The determination unit 304 transmits the determination result indicating that the risk of colorectal cancer recurrence in the subject is high (high-risk) to the output unit 305. On the other hand, when the levels of expression are lower than the standard values, the routine proceeds to step S1-6.

The reception unit 301 of the diagnosis supporting apparatus 1 obtains information on the colored fluorescence regarding the levels of expression of genes selected from the first gene group from the measurement device 2 (step S1-6). The calculation unit 303 calculates the fluorescence intensity from the obtained information and transmits it to the storage unit 302 (step S1-7). The calculation unit 303 calculates the levels of expression of genes according to the stored formulae using the stored fluorescence intensity (step S1-8).

Thereafter, the determination unit 304 determines whether the levels of expression calculated by the calculation unit 303 are more than or equal to the standard values stored in the storage unit 302 (step S1-9). When the levels of expression are more than or equal to the standard values, the routine proceeds to step S1-11. When the levels of expression are lower than the standard values, the routine proceeds to step S1-10. The determination unit 304 determines that the risk of colorectal cancer recurrence in the subject is medium (medium-risk), and then the routine proceeds to step S1-17.

The reception unit 301 of the diagnosis supporting apparatus 1 obtains information on the colored fluorescence regarding the levels of expression of genes selected from the second gene group from the measurement device 2 (step S1-11). The calculation unit 303 calculates the fluorescence intensity from the obtained information and transmits it to the storage unit 302 (step S1-12). The calculation unit 303 calculates the levels of expression of genes according to the stored formulae using the stored fluorescence intensity (step S1-13).

Thereafter, the determination unit 304 determines whether the levels of expression calculated by the calculation unit 303 are more than or equal to the standard values stored in the storage unit 302 (step S1-14). When the levels of expression are more than or equal to the standard values, the routine proceeds to step S1-15. The determination unit 304 determines that the risk of colorectal cancer recurrence in the subject is medium (medium-risk), and then the routine proceeds to step S1-17. On the other hand, when the levels of expression are lower than the standard values in step S1-14, the routine proceeds to step S1-16. The determination unit 304 transmits the determination result indicating that the risk of colorectal cancer recurrence in the subject is low (low-risk) to the output unit 305.

When the specimen determined to have a medium risk of colorectal cancer recurrence through step S1-10 or step S1-15, the data "classification into two groups is necessary" is input from the input unit 3b (step S1-17). In this case, these specimens are determined whether the risk of colorectal cancer recurrence is high or low based on KRAS gene mutation measurement.

When the data "classification into two groups is necessary" is not input, the routine proceeds to step S1-18. The determination result indicating that the risk of colorectal cancer recurrence in the subject is medium (medium-risk) is transmitted to the output unit 305.

On the other hand, when the classification into two groups is necessary, the routine proceeds to step S1-19. The specimen determined to have a medium risk is determined whether the risk of colorectal cancer recurrence is high or low based on the presence of KRAS gene mutation (step S1-19). The mutation measuring device 4 is used to perform this process.

The reception unit 301 obtains the information on the sequence of the KRAS gene in the subject determined to have a medium risk (step S1-19). Then, the determination unit 304 compares the obtained sequence of the KRAS gene to the nonmutant sequences of the KRAS gene stored in the storage unit 302 and determines whether any mutation is present in the KRAS gene in the biological sample of the subject (step S1-20). When the KRAS gene has a mutation, the routine proceeds to step S1-21. The determination unit 304 transmits the determination result indicating that the risk of colorectal cancer recurrence in the subject is high (high-risk) to the output unit 305. On the other hand, when the KRAS gene has no mutation, the routine proceeds to step S1-22. The determination unit 304 transmits the determination result indicating that the risk of colorectal cancer recurrence in the subject is low (low-risk) to the output unit 305.

The output unit 305 outputs the determination result of the risk of colorectal cancer recurrence in the subject and allows the display unit 3c to display the determination result (step S1-23). Accordingly, the diagnosis supporting apparatus 1 can provide information to support the determination whether the risk of colorectal cancer recurrence in the subject is high, medium or low to a doctor or the like.

The present disclosure also includes a system suitable for determining a risk of colorectal cancer recurrence in a subject.

The storage unit 302 stores a computer program for causing the computer system 3 to execute the following processing:

receiving, in a biological sample collected from a patient with colorectal cancer, the levels of expression of a plurality of genes selected from a first gene group present in a region from 18q21 to 18q23 on the long arm of chromosome 18, the levels of expression of a plurality of genes selected from a second gene group present in a region from 20q11 to 20q13 on the long arm of chromosome 20, and the levels of expression of a plurality of genes selected from a third gene group including ANGPTL2, AXL, C1R, C1S, CALHM2, CTSK, DCN, EMP3, GREM1, ITGAV, KLHL5, MMP2, RAB34, SELM, SRGAP2P1, and VIM; and determining the risk of colorectal cancer recurrence in the patient based on the received levels of expression.

In the method of the embodiment, the risk of colorectal cancer recurrence in the subject is determined based on the analysis result obtained in the above analysis step. For example, it is possible to provide a determination result, such as a high, medium or low possibility of the risk of colorectal cancer recurrence in the subject. Providing the above determination result supports the doctor or the like to diagnose the possibility of colorectal cancer recurrence.

In the method of the embodiment, a doctor or the like may perform the treatment based on the determination result obtained in the above determination step. For example, when biological samples collected from patients with colorectal cancer in stage II are determined as a low-risk group in the above determination step, an anticancer drug is not administered, whereas when the biological samples collected from the patients with colorectal cancer in stage II are determined as a high-risk group in the above determination step, the anticancer drug may be administered. Although the anticancer drug is not generally administered to the patients with colorectal cancer in stage II, the anticancer drug can be appropriately administered only to the patients with a high risk of recurrence among the patients with colorectal cancer in stage II under the above condition. Further, when biological samples collected from patients with colorectal cancer in stage III are determined as a low-risk group in the above determination step, the anticancer drug is not administered, whereas when the biological samples collected from the patients with colorectal cancer in stage III are determined as a high-risk group in the above determination step, the anticancer drug may be administered. Although the anticancer drug is generally administered to the patients with colorectal cancer in stage III, the anticancer drug is not administered to the patients with a low risk of recurrence among the patients with colorectal cancer in stage III under the above condition, whereby the patients' burdens can be reduced.

Examples of anticancer drugs to be administered to the patients include 5-fluorouracil anticancer drugs and oxaliplatin. Examples of 5-fluorouracil anticancer drugs include Tegafur/Uracil, Tegafur/Gimeracil/Oteracil, and capecitabine.

Another aspect of the present invention is a method for treatment of colorectal cancer, comprising the steps of:

performing a first measurement to measure levels of expression of a plurality of genes selected from a first gene group present in a region from 18q21 to 18q23 on a long arm of chromosome 18 in a biological sample collected from a patient with colorectal cancer, a second measurement to measure levels of expression of a plurality of genes selected from a second gene group present in a region from 20q11 to 20q13 on a long arm of chromosome 20, and a third measurement to measure levels of expression of a plurality of genes selected from a third gene group consisting of ANGPTL2, AXL, C1R, C1S, CALHM2, CTSK, DCN, EMP3, GREM1, ITGAV, KLHL5, MMP2, RAB34, SELM, SRGAP2P1, and VIM;

determining the risk of colorectal cancer recurrence of the patient based on results of the first measurement, second measurement and third measurement; and when the biological sample collected from the patient with colorectal cancer is determined as a high-risk group in the determination step, treating the patient with an anticancer drug.

Another aspect of the present invention is a method for administration of an anticancer drug, comprising the steps of:

performing a first measurement to measure levels of expression of a plurality of genes selected from a first gene group present in a region from 18q21 to 18q23 on a long arm of chromosome 18 in a biological sample collected from a patient with colorectal cancer, a second measurement to measure levels of expression of a plurality of genes selected from a second gene group present in a region from 20q11 to 20q13 on a long arm of chromosome 20, and a third measurement to measure levels of expression of a plurality of genes selected from a third gene group consisting of ANGPTL2, AXL, C1R, C1S, CALHM2, CTSK, DCN, EMP3, GREM1, ITGAV, KLHL5, MMP2, RAB34, SELM, SRGAP2P1, and VIM;

determining the risk of colorectal cancer recurrence of the patient based on results of the first measurement, second measurement and third measurement; and when the biological sample collected from the patient with colorectal cancer is determined as a high-risk group in the determination step, administrating the anticancer drug to the patient.

EXAMPLES

Example 1

Examination of Classification with Respect to Prognosis of Patients with Colorectal Cancer <Method>

Among data sets GSE14333 of the GeneChip Human Genome U133 plus 2.0 Array (Affymetrix, Inc.) (obtained from the NCBI Gene Expression Omnibus (URL; http://www.ncbi.nlm.nih.gov/geo/), 72 colorectal cancer (colon cancer) patient cases were used as a training set. Array data analysis software (Expression Console v1.1 (manufactured by Affymetrix, Inc.)), spreadsheet software (Office Excel 2002, 2007 (manufactured by Microsoft)), cluster analysis software (Cluster3.0, Java (registered trademark)) Treeview (available from; http://bonsai.hgc.jp/~mdehoon/software/cluster/software.htm)), and statistical analysis software (MedCalc (manufactured by MedCalc)) were used to perform various analyses.

MAS5 was used to normalize the data. Among all the probes on the GeneChip, the probes of which gene symbol was unclear and the probes having an average expression signal value of less than 300 were excluded from the analysis. As for the probes of which corresponding genes overlapped each other, the probe having the maximum average expression signal value was used as a representative and the rest of the probes were excluded. After Z-transformation of the signal values, the unsupervised hierarchy clustering was performed according to the method of distance of closest approach. The similarity measure was defined as the Pearson correlation coefficient.

From the cluster analysis result, a gene cluster was considered to satisfy two conditions: (1) reflection of important biological functions; and (2) contribution to generation of clusters of characteristic cases. The gene cluster was defined as a functional module and extracted. The method of classifying the risk recurrence groups was constructed by repeatedly performing clustering according to a combination of the functional modules.

<Result>

Figure 5:
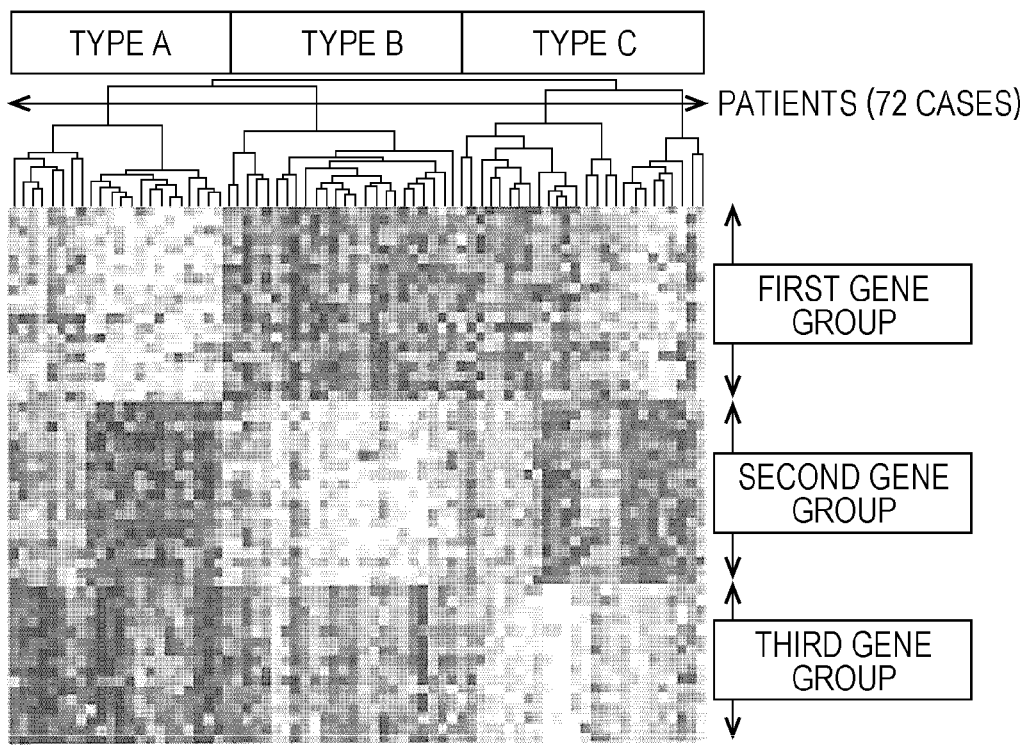
FIG. 5 is a view showing the result of classification of cases in a training set into risk recurrence groups.

FIG. 5 shows the result of classification of cases in a training set into risk recurrence groups. Based on the average value of the levels of expression of genes in all the patient cases, the increase-decrease rates of the levels of expression will be determined hereinafter. For example, when the levels of expression of certain genes are more than or equal to the above average value, the levels of expression are determined to be relatively increased. When the levels of expression of certain genes are smaller than the above average value, the levels of expression are determined to be relatively decreased. Referring to FIG. 5, cases showing a relative decrease in the expression level of the gene group on the long arm of chromosome 18 (hereinafter may be referred to as "first gene group" or "18q Loss module") or cases showing a relative increase in the expression level of the gene group on the long arm of chromosome 20 (hereinafter may be referred to as "second gene group" or "20q Amp module") were extracted from the training set. The cases were defined as a type B. Cases having the expression patterns of the 18q Loss module and the 20q Amp module opposite to those of the type B were extracted from the training set. The cases were defined as a type A. In the training set, cases characterized by strong expression in the stroma-related gene group appeared with no relation to the levels of expression of genes in the types A and B. Accordingly, these cases were defined as an independent type C. Table 1 shows genes forming the three functional modules used.

TABLE 1

| Module | Gene symbol | Probe set ID | GenBank ID | SEQ ID NO: |
|---|---|---|---|---|
| 18q Loss | C18orf22 | 219419_at | NM_024805 | SEQ ID NO: 1 |
| | C18orf55 | 223180_s_at | BC000892 | SEQ ID NO: 2 |
| | CCDC68 | 220180_at | NM_025214 | SEQ ID NO: 3 |
| | CNDP2 | 217752_s_at | NM_018235 | SEQ ID NO: 4 |
| | CYB5A | 209366_x_at | M22865 | SEQ ID NO: 5 |
| | LOC400657 | 226924_at | AI016355 | SEQ ID NO: 6 |
| | LOC440498 | 232594_at | AK001829 | SEQ ID NO: 7 |
| | MBD2 | 202484_s_at | AF072242 | SEQ ID NO: 8 |
| | MBP | 225407_at | N37023 | SEQ ID NO: 9 |
| | MY05B | 225301_s_at | AI991160 | SEQ ID NO: 10 |
| | NARS | 200027_at | NM_004539 | SEQ ID NO: 11 |
| | PQLC1 | 218208_at | NM_025078 | SEQ ID NO: 12 |
| | RTTN | 227072_at | BG167480 | SEQ ID NO: 13 |
| | SEC11C | 223299_at | AF212233 | SEQ ID NO: 14 |
| | SOCS6 | 227542_at | AU157543 | SEQ ID NO: 15 |
| | TNFRSF11A | 238846_at | AW026379 | SEQ ID NO: 16 |
| | TXNL1 | 201588_at | NM_004786 | SEQ ID NO: 17 |
| | TXNL4A | 202836_s_at | NM_006701 | SEQ ID NO: 18 |
| | VPS4B | 218171_at | AF195514 | SEQ ID NO: 19 |
| | ZNF407 | 227768_at | AB051490 | SEQ ID NO: 20 |
| 20q Amp | ASXL1 | 212237_at | N64780 | SEQ ID NO: 21 |
| | C20orf112 | 225224_at | AL034550 | SEQ ID NO: 22 |
| | C20orf177 | 225313_at | AI627538 | SEQ ID NO: 23 |
| | CHMP4B | 225498_at | AV713673 | SEQ ID NO: 24 |
| | COMMD7 | 224815_at | AA148301 | SEQ ID NO: 25 |
| | CPNE1 | 206918_s_at | NM_003915 | SEQ ID NO: 26 |
| | DID01 | 218325_s_at | NM_022105 | SEQ ID NO: 27 |
| | DNAJC5 | 224611_s_at | AL118506 | SEQ ID NO: 28 |

TABLE 1-continued

| Module | Gene symbol | Probe set ID | GenBank ID | SEQ ID NO: |
|---|---|---|---|---|
| | KIF3B | 203943_at | NM_004798 | SEQ ID NO: 29 |
| | NCOA6 | 208979_at | AF128458 | SEQ ID NO: 30 |
| | PHF20 | 209422_at | AL109965 | SEQ ID NO: 31 |
| | PIGU | 225903_at | AL118520 | SEQ ID NO: 32 |
| | PLAGL2 | 202925_s_at | NM_002657 | SEQ ID NO: 33 |
| | POFUT1 | 212349_at | AL045513 | SEQ ID NO: 34 |
| | PPP1R3D | 204554_at | AL109928 | SEQ ID NO: 35 |
| | PTPN1 | 202716_at | NM_002827 | SEQ ID NO: 36 |
| | RBM39 | 207941_s_at | NM_004902 | SEQ ID NO: 37 |
| | TAF4 | 213090_s_at | AI744029 | SEQ ID NO: 38 |
| | TCFL5 | 204849_at | NM_006602 | SEQ ID NO: 39 |
| Stroma-related gene group | ANGPTL2 | 213001_at | AF007150 | SEQ ID NO: 40 |
| | AXL | 202686_s_at | NM_021913 | SEQ ID NO: 41 |
| | C1R | 212067_s_at | AL573058 | SEQ ID NO: 42 |
| | C1S | 208747_s_at | M18767 | SEQ ID NO: 43 |
| | CALHM2 | 57715_at | W72694 | SEQ ID NO: 44 |
| | CTSK | 202450_s_at | NM_000396 | SEQ ID NO: 45 |
| | DCN | 201893_x_at | AF138300 | SEQ ID NO: 46 |
| | EMP3 | 203729_at | NM_001425 | SEQ ID NO: 47 |
| | GREM1 | 218469_at | NM_013372 | SEQ ID NO: 48 |
| | ITGAV | 202351_at | AI093579 | SEQ ID NO: 49 |
| | KLHL5 | 226001_at | AK002174 | SEQ ID NO: 50 |
| | MMP2 | 201069_at | NM_004530 | SEQ ID NO: 51 |
| | RAB34 | 1555630_a_at | AF327350 | SEQ ID NO: 52 |
| | SELM | 226051_at | BF973568 | SEQ ID NO: 53 |
| | SRGAP2P1 | 229067_at | BF977829 | SEQ ID NO: 54 |
| | VIM | 201426_s_at | AI922599 | SEQ ID NO: 55 |

Table 2 shows the number of cases classified into each of the types as described above (abundance ratio) as well as and the rate of recurrence of colorectal cancer.

TABLE 2

| | Abundance ratio | Recurrence rate |
|---|---|---|
| Type A | 30.6% (22) | 4.5% (1) |
| Type B | 33.3% (24) | 12.5% (3) |
| Type C | 36.1% (26) | 23.1% (6) |
| Total | 100% (72) | 13.9% (10) |

Referring to Table 2, among all the 72 cases, 22 cases were classified into the type A, 24 cases were classified into the type B, and 26 cases were classified into the type C. The colorectal cancer recurrence rates in the type A, the type B, and the type C were 4.5%, 12.5%, and 23.1% respectively.

Figure 6:
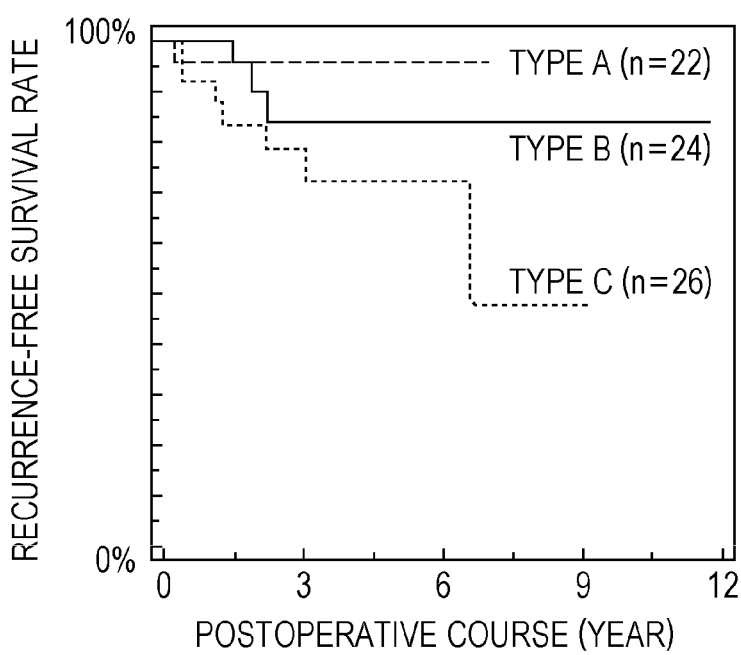
FIG. 6 illustrates Kaplan-Meier curves showing the risk of recurrence in respective risk groups.

FIG. 6 illustrates Kaplan-Meier curves created for each of the classified types. Referring to FIG. 6, it is found that the postoperative recurrence-free survival rates in respective types largely differ from one another.

The results shown in Table 2 and FIG. 6 indicate that the type A can be defined as the low-risk group of recurrence, the type B can be defined as the medium-risk group of recurrence, and the type C can be defined as the high-risk group of recurrence. Hereinafter, the low-risk group, the medium-risk group, and the high-risk group may be collectively referred to as "risk recurrence group".

Example 2

1. Verification of Reliability of Classification into Risk Recurrence Groups

<Method>

Among data sets GSE14333 of the GeneChip Human Genome U133 plus 2.0 Array (Affymetrix, Inc.) (obtained from the NCBI Gene Expression Omnibus (URL;http://www.ncbi.nlm.nih.gov/geo/), 74 patient cases, which were not used as the training set, were used as a validation set 1. The cases in the training set and the cases in the validation set 1 were selected so that these cases were specimens from different medical centers.

A total of 72 cases in the training set and 74 cases in the validation set (146 cases) were clustered using the genes of Table 1 in the same manner as Example 1.

<Result>

Figure 7:
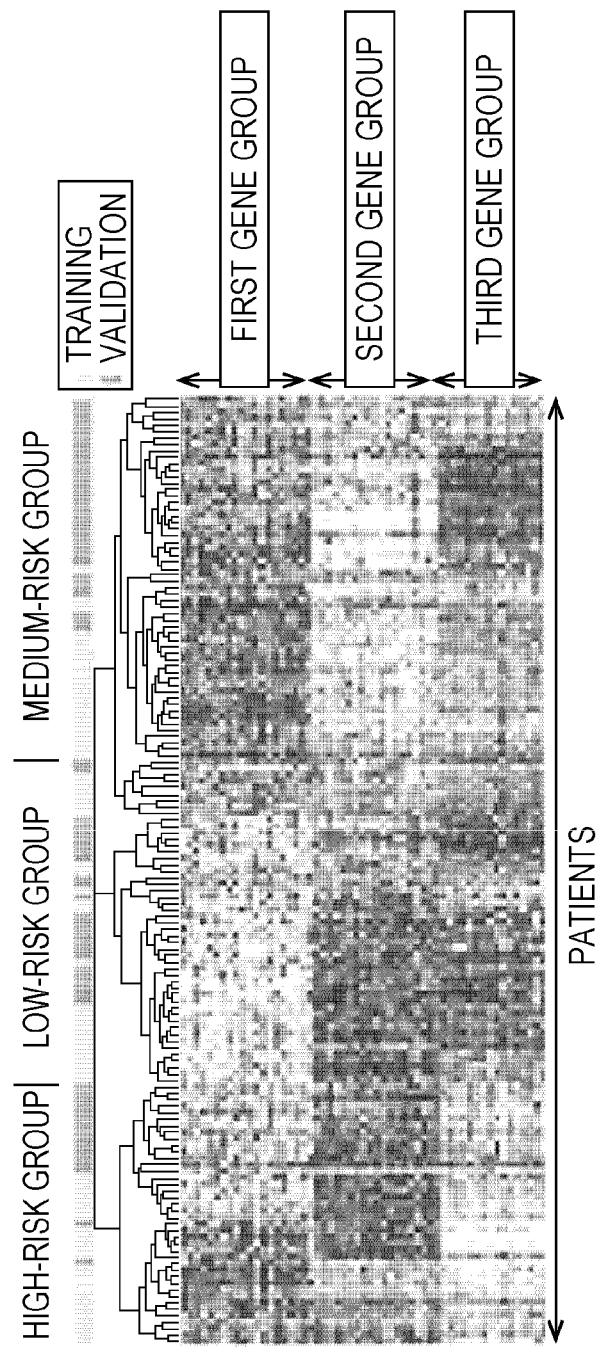
FIG. 7 is a view showing the result of classification of cases in a training set and a validation set 1 into risk recurrence groups.

FIG. 7 shows the result of classification of cases in the training set and the validation set 1 into risk recurrence groups. Referring to FIG. 7, it is found that the biological samples in the training set and the validation set 1 were obtained from different centers, however, no cluster originated from the different centers was formed, and all the cases were classified into any of the three risk recurrence groups.

Example 3

2. Verification of Reliability of Classification into Risk Recurrence Groups

<Method>

Among data sets GSE14333 of the GeneChip Human Genome U133 plus 2.0 Array (Affymetrix, Inc.) (obtained from the NCBI Gene Expression Omnibus (URL;http://www.ncbi.nlm.nih.gov/geo/), 53 colorectal cancer (colon cancer) patient cases were used as a validation set 2. The 53 cases were clustered using the genes of Table 1 in the same manner as Example 1.

<Result>

Figure 8:
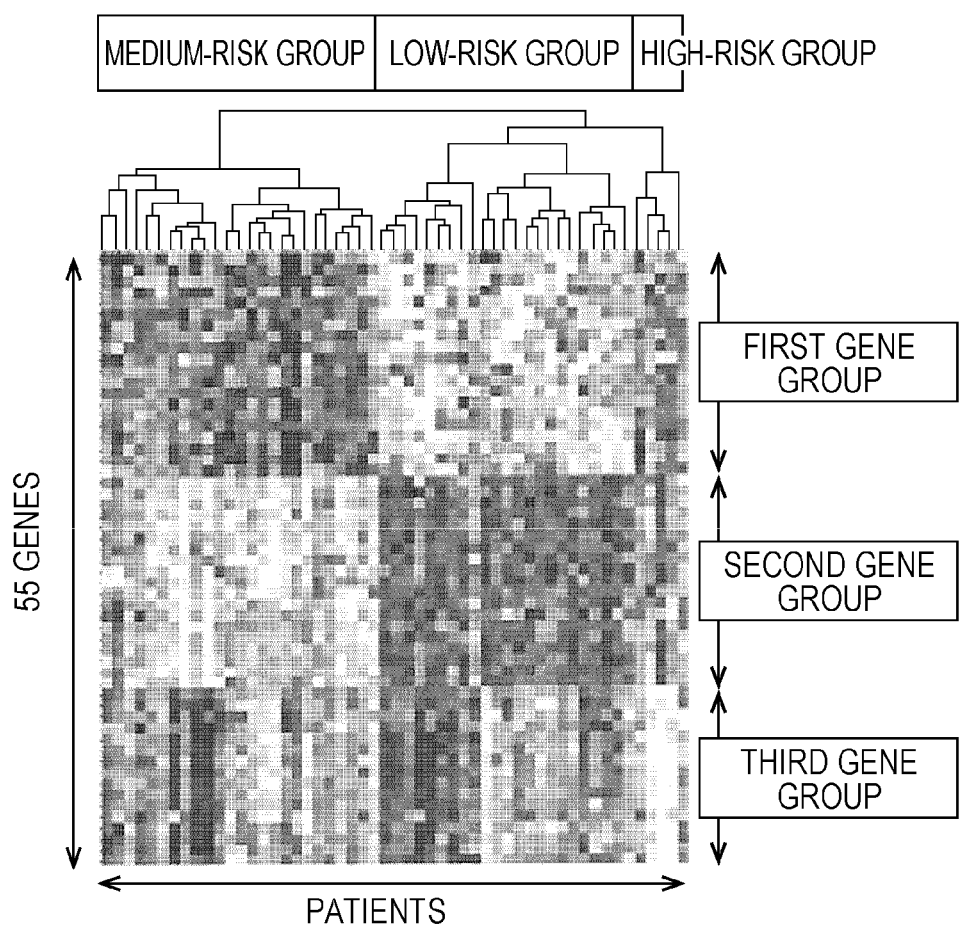
FIG. 8 is a view showing the result of classification of cases in a validation set 2 into risk recurrence groups.

FIG. 8 shows the result of classification of cases in a validation set 2 into risk recurrence groups. Referring to FIG. 7, it is found that the biological samples in the training set and the validation set 2 were obtained from different centers and the biological samples were measured with the GenChip in different centers. However, all the cases in the validation set 2 were classified into any of the three risk recurrence groups.

Table 3 shows the number of cases classified into each of the types as described above (abundance ratio) as well as and the rate of recurrence of colorectal cancer.

TABLE 3

| | Abundance ratio | Recurrence rate |
|---|---|---|
| Low-risk group | 43.4% (23) | 8.7% (2) |
| Medium-risk group | 47.2% (25) | 28.0% (7) |
| High-risk group | 9.4% (5) | 80.0% (4) |
| Total | 100% (53) | 24.5% (13) |

Referring to Table 3, among all the 53 cases, 23 cases were classified into the low-risk group, 25 cases were classified into the medium-risk group, and 5 cases were classified into the high-risk group. The colorectal cancer recurrence rates in the low-risk group, the medium-risk group, and the high-risk group were 8.7%, 28.0%, and 80.0%, respectively. The result of Table 3 indicates that the biological samples in the training set and the validation set 2 were obtained from different centers and the biological samples were measured with the GenChip in different centers, however, each of the risk recurrence groups showed the same result as Example 1 without being influenced by the difference in center.

Example 4

3. Verification of Reliability of Classification into Risk Recurrence Groups <Method>

Among data sets GSE39582 of the GeneChip Human Genome U133 plus 2.0 Array (Affymetrix, Inc.) (obtained from the NCBI Gene Expression Omnibus (URL;http://www.ncbi.nlm.nih.gov/geo/), 258 colorectal cancer (colon cancer) patient cases were used as a validation set 3. The 256 cases were clustered using the genes of Table 1 in the same manner as Example 1.

<Result>

Figure 9:
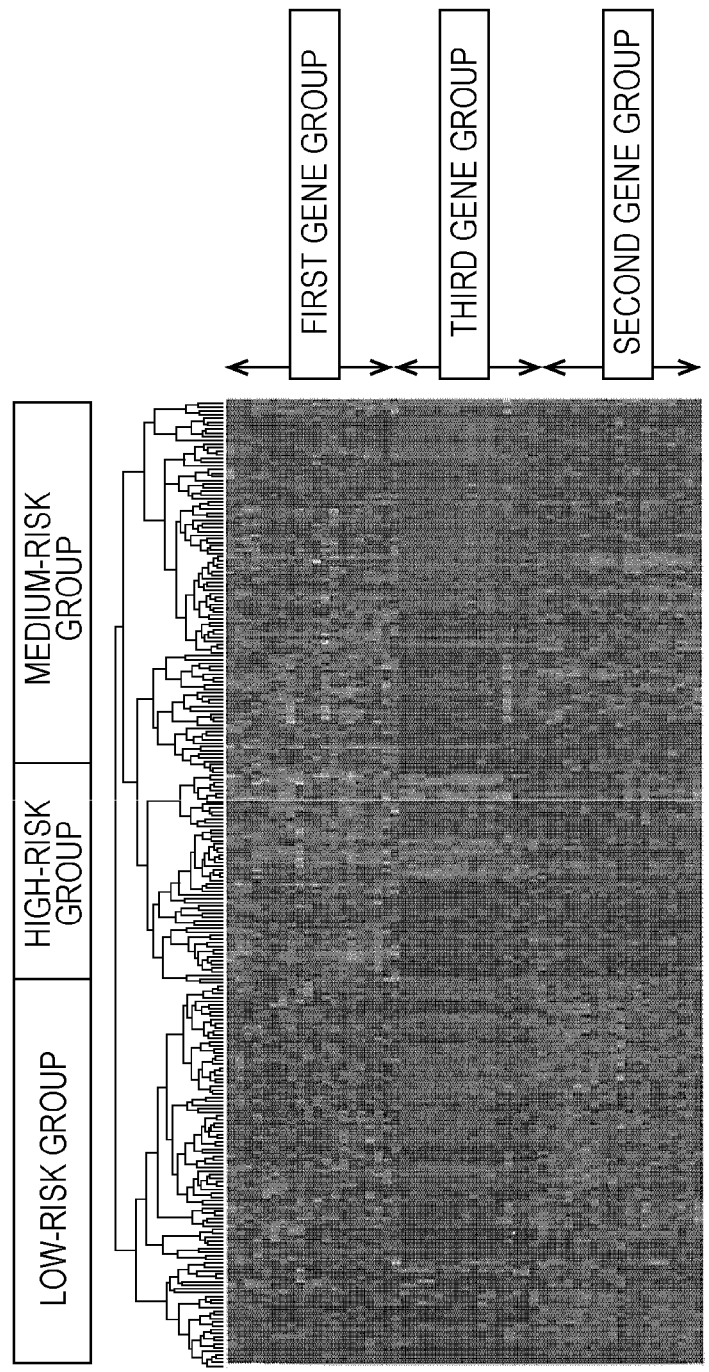
FIG. 9 is a view showing the result of classification of cases in a validation set 3 into risk recurrence groups.

FIG. 9 shows the result of classification of cases in a validation set 3 into risk recurrence groups. Referring to FIG. 9, it is found that the biological samples in the training set and the validation set 3 were obtained from different centers and the biological samples were measured with the GenChip in different centers. However, all the cases in the validation set 3 were classified into any of the three risk recurrence groups.

Table 4 shows the number of cases classified into each of the types as described above (abundance ratio) as well as and the rate of recurrence of colorectal cancer.

TABLE 4

|  | Abundance ratio | Recurrence rate |
| --- | --- | --- |
| Low-risk group | 28.7% (74) | 12.2% (9) |
| Medium-risk group | 47.7% (123) | 23.6% (29) |
| High-risk group | 23.6 (%) | 39.3% (24) |
| Total | 100% (258) | 24.0% (62) |

Referring to Table 4, among all the 258 cases, 74 cases were classified into the low-risk group, 123 cases were classified into the medium-risk group, and 61 cases were classified into the high-risk group. The colorectal cancer recurrence rates in the low-risk group, the medium-risk group, and the high-risk group were 12.2%, 23.6%, and 39.3%, respectively.

Figure 10:
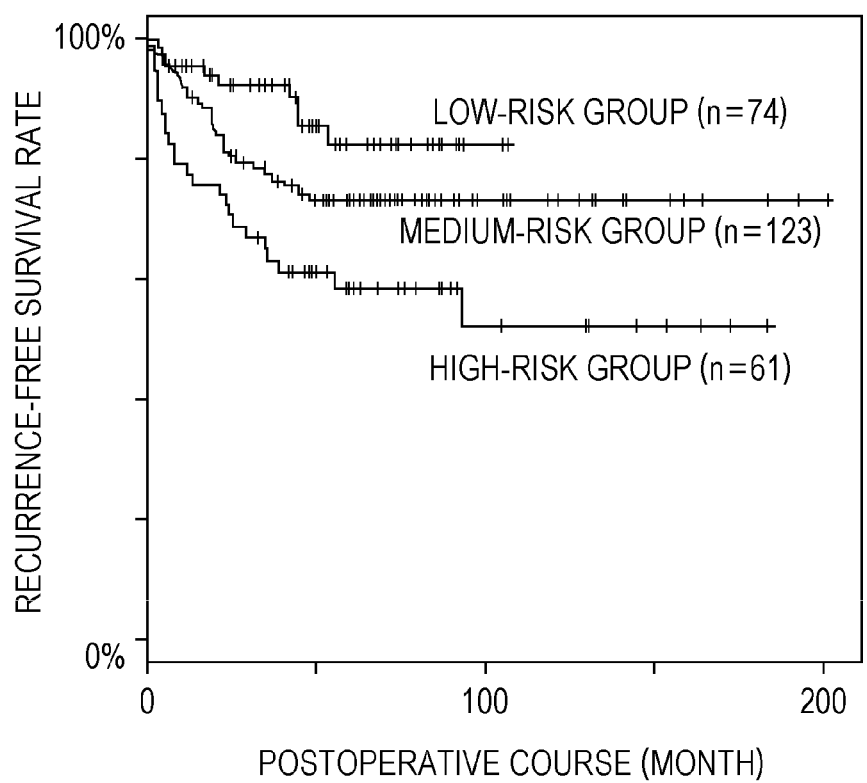
FIG. 10 illustrates Kaplan-Meier curves according to Dukes' classification of cases in the validation set 3.

FIG. 10 illustrates Kaplan-Meier curves created for each of the classified types. Referring to FIG. 10, it is found that the postoperative recurrence-free survival rates in respective types largely differ from one another. The results of Table 4 and FIG. 10 indicate that the biological samples in the training set and the validation set 3 were obtained from different centers and the biological samples were measured with the GenChip in different centers, however, each of the risk recurrence groups showed the same result as Example 1 without being influenced by the difference in center.

Example 5

4. Verification of Reliability of Classification into Risk Recurrence Groups Data on 85 colorectal cancer (colon cancer) patient cases was obtained by measuring specimens obtained from National Defense Medical College with the GeneChip Human Genome U133 plus 2.0 Array (Affymetrix, Inc.). The data was used as a validation set 4. The 85 cases were clustered using the genes of Table 1 in the same manner as Example 1.

<Result>

Figure 11:
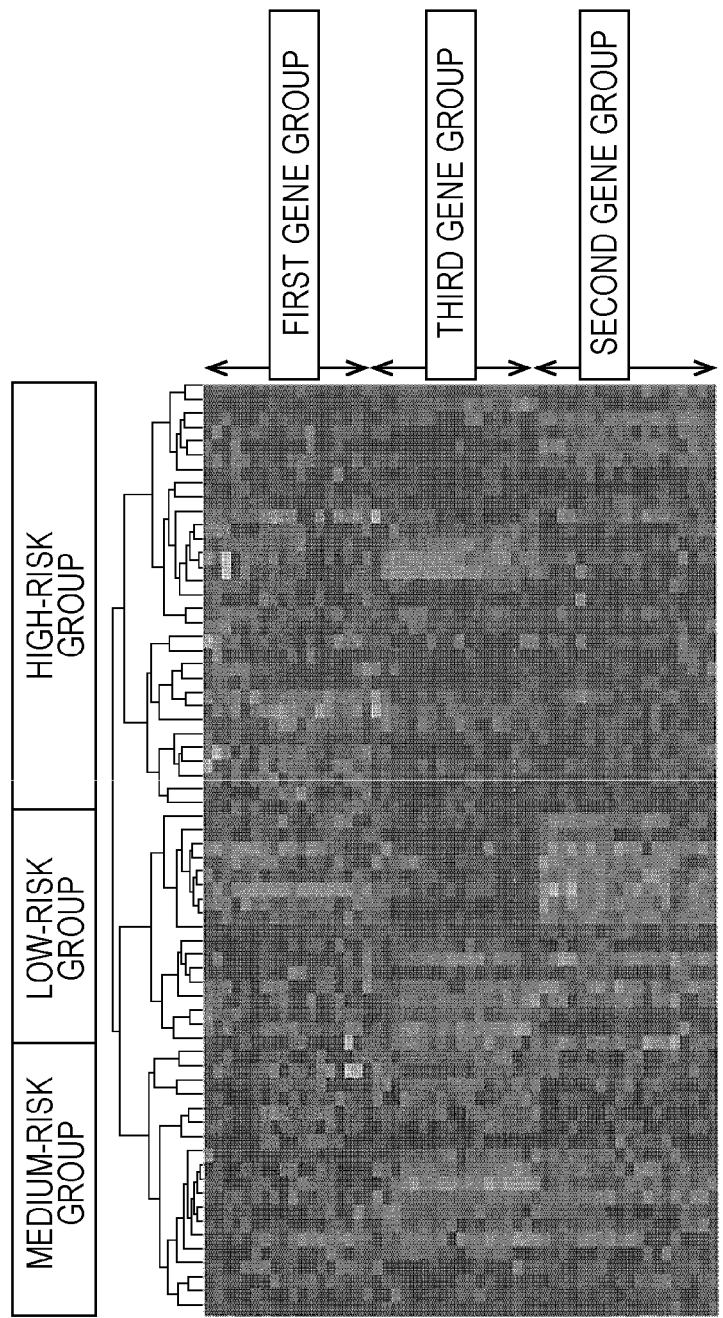
FIG. 11 is a view showing the result of classification of cases in a validation set 4 into risk recurrence groups.

FIG. 11 shows the result of classification of cases in a validation set 4 into risk recurrence groups. Referring to FIG. 11, it is found that the biological samples in the training set and the validation set 4 were obtained from different centers and the biological samples were measured with the GenChip in different centers. However, all the cases in the validation set 4 were classified into any of the three risk recurrence groups.

Table 5 shows the number of cases classified into each of the types as described above (abundance ratio) as well as and the rate of recurrence of colorectal cancer.

TABLE 5

|  | Abundance ratio | Recurrence rate |
| --- | --- | --- |
| Low-risk group | 27.1% (23) | 0% (0) |
| Medium-risk group | 30.6% (26) | 11.5% (3) |
| High-risk group | 42.3% (36) | 22.2% (8) |
| Total | 100% (85) | 12.9% (11) |

Referring to Table 5, among all the 85 cases, 23 cases were classified into the low-risk group, 26 cases were classified into the medium-risk group, and 36 cases were classified into the high-risk group. The colorectal cancer recurrence rates in the low-risk group, the medium-risk group, and the high-risk group were 0%, 11.5%, and 22.2%, respectively.

Figure 12:
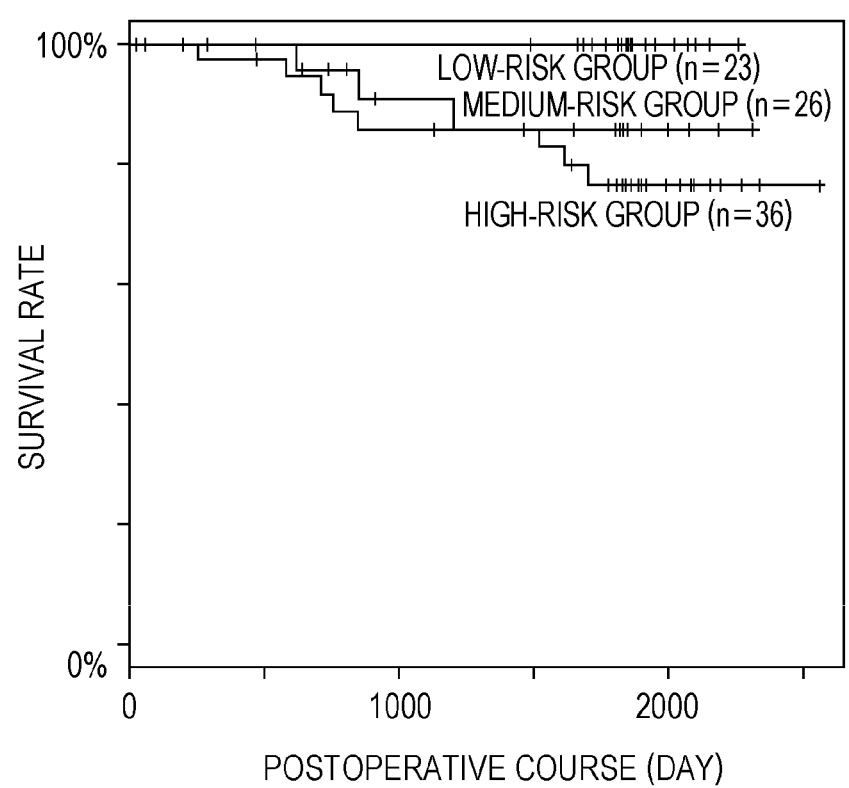
FIG. 12 illustrates Kaplan-Meier curves according to Dukes' classification of cases in the validation set 4.

FIG. 12 illustrates Kaplan-Meier curves created for each of the classified types. Referring to FIG. 12, it is found that the postoperative recurrence-free survival rates in respective types largely differ from one another.

The result of Table 5 indicates that the case of the validation set 4 showed the same result as Example 1.

As described above, the colorectal cancer cases were classified into the three risk recurrence groups by the analysis of the functional modules. Each of the risk recurrence groups had different recurrence risks. The results of Examples 1 to 5 indicate that the classification into the risk recurrence groups is a reliable classification method that is not influenced by sources for obtaining data sets. Therefore, it is shown that the method for supporting a diagnosis of a risk using the classification into the colorectal cancer recurrence risk groups in the embodiment gave sufficiently-stable and reliable results.

Comparative Example

Prognosis Prediction by Conventional Method (Dukes' Classification)

Figure 13:
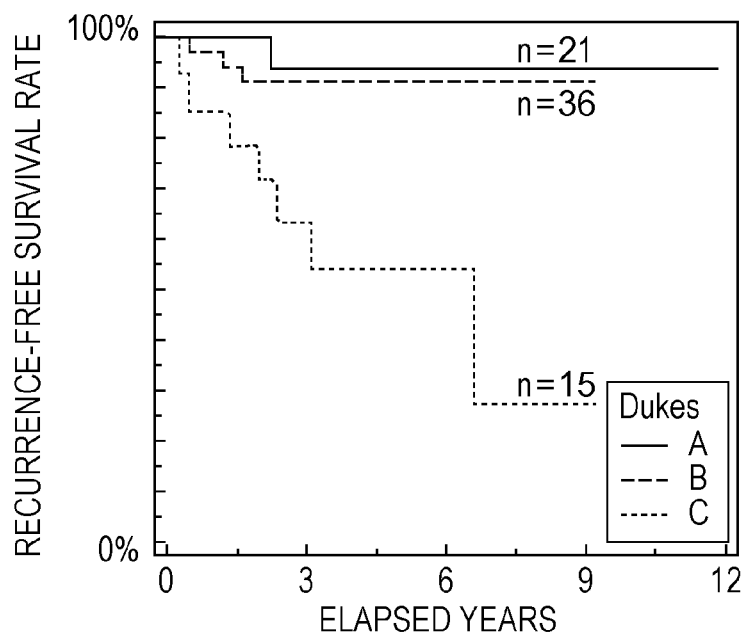
FIG. 13 illustrates Kaplan-Meier curves according to Dukes' classification of cases in a training set.

As comparative controls for the prognostic predicting performance, the survival time of 72 cases in the training set was analyzed by Dukes' classification. The result is shown in FIG. 13. In FIG. 13, Dukes A indicates cancer confined to the wall of the large intestine, Dukes B indicates nodenegative cancer penetrated through the wall of the large intestine, and Dukes C indicates node-positive cancer.

Referring to FIG. 2 and FIG. 13, 26 cases were determined to have a high risk by the diagnosis supporting method of the embodiment, while 15 cases were determined to have a high risk by the determination method of Comparative example (Dukes C). There is little difference in recurrence-free survival rate between the cases determined to be Dukes A and the cases determined to be Dukes B based on the determination method of Comparative example. On the other hand, there are differences in recurrence-free survival rate between the cases determined as the low-risk group and the cases determined as the medium-risk group based on the diagnosis supporting method of the embodiment. This result suggests that the method for supporting a diagnosis of a risk of recurrence in the embodiment enables the risk of recurrence to be determined with high accuracy compared to the conventional pathologic classification.

Example 6

1. Improvement in Prognostic Predicting Performance Based on Stratification of Medium-Risk Group by KRAS Gene Mutation Among the specimens determined as the medium-risk group (as the analysis results in Example 4), the specimens having a KRAS gene mutation were determined to be high-risk and the specimens having no KRAS gene mutation were determined to be low-risk. All the specimens were divided into two groups (refer to FIG. 14). Specifically, the presence of the KRAS mutations in DNA in the specimens was measured in the following manner. Based on the result, all the specimens were divided into the two groups.

Each of the PCR Master Mix solutions having the composition of Table 6 below was first prepared.

TABLE 6

|  | Volume (for 5 tubes) |
| --- | --- |
| 10 × Ex Taq Buffer | 10 µl |
| dNTP (2.5 mM) | 8 µl |
| TaKaRa EX Taq HS (1 unit/ul) | 2 µl |
| Forword Primer (10 uM) | 2 µl |
| Reverse Primer (10 uM) | 2 µl |
| total volume | 24 µl |

Next, 10 ng of genomic DNA was dispensed into a 0.5 ml PCR tube, and nuclease free water was added so as to be a total amount of 20 µL. Then, each of the PCR Master Mix solution was added thereto at 4.8 µl/tube, which was mixed. The primers added to each of the PCR Master Mix solutions are shown in Table 7 below. The primer pair of SEQ ID NOs: 57 and 58 was used to amplify the region containing the 12th and 13th codons at exon 2 of the KRAS gene. The primer pair of SEQ ID NOs: 59 and 60 was used to amplify the region containing the 61st codon located at exon 3.

TABLE 7

| Primer name | Base sequence | SEQ ID NO: |
| --- | --- | --- |
| KRAS exon2 Forward Primer | CGATACACGTCTGCAGTCAAC | 57 |
| KRAS exon2 Reverse Primer | ACCCTGACATACTCCCAAGG | 58 |
| KRAS exon3 Forward Primer | AGGTGCTTAGTGGCCATTTG | 59 |
| KRAS exon3 Reverse Primer | TGCATGGCATTAGCAAAGAC | 60 |

Each of the obtained PCR master Mix solutions was set in a thermal cycler.

The following programs were carried out in order to amplify the sequences of exons 2 and 3 of KRAS by PCR.
KRAS exon 2
95° C.: 10 min→(94° C.: 1 min→55° C.: 1 min→72° C.: 1 min)×38 cycle→72° C.: 10 min→4° C. hold
KRAS exon 3
95° C.: 10 min→(94° C.: 1 min→63° C.: 1 min→72° C.: 1 min)×38 cycle→72° C.: 10 min→4° C. hold After amplification, a single band was confirmed by electrophoresis through a 1% agarose gel. Thereafter, 5 µl of the PCR product was dispensed into a 0.5 ml PCR tube and 2 µl of ExoSAP-IT was added, which was mixed. The resultant mixture was set in the thermal cycler and the following program was carried out:
37° C. 15 min→80° C. 15 min→4° C. hold 9.6 µl of F or R primer (1 pmol/µl) and 9.4 µl of NFW were added to 2 µl of the resultant product, which was mixed. The sequence analysis was entrusted to Operon Biotechnologies, Inc. When the base sequence to be analyzed was compared to the base sequence of SEQ ID NO: 1 and at least one mutation was observed, it was determined to have a KRAS gene mutation. As for the specimens determined as the medium-risk group in Example 4, the specimens having any KRAS gene mutation were classified into the high-risk group and the specimens having no KRAS gene mutation was classified into the low-risk group.

Figure 14:
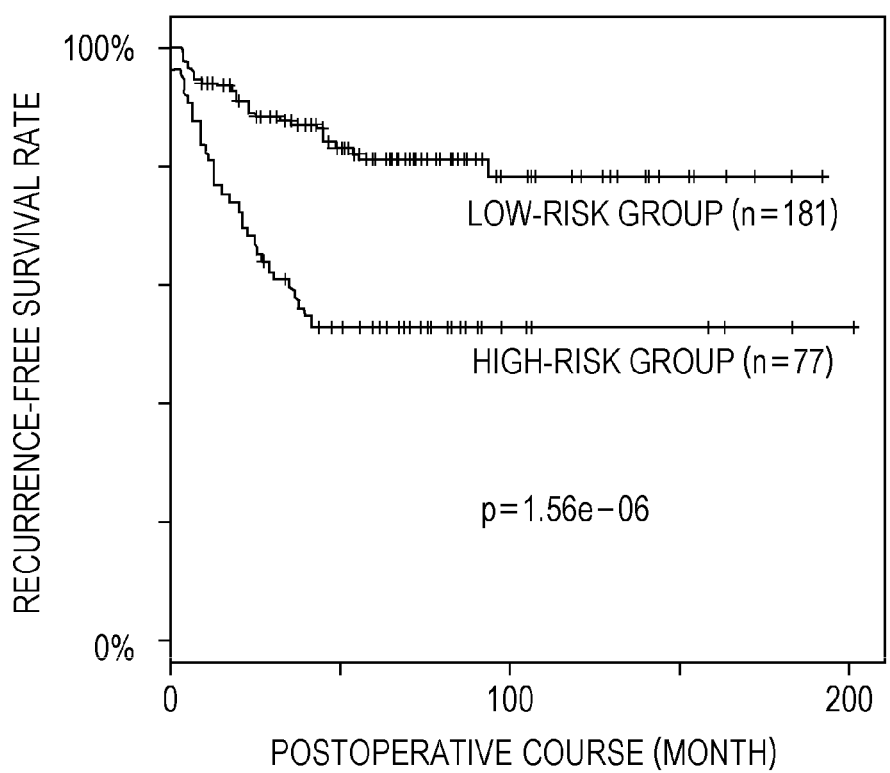
FIG. 14 illustrates Kaplan-Meier curves showing the result of recurrence risk classification of specimens which have been determined as a medium-risk group in Example 4 according to the presence of KRAS gene mutations in the specimens.

The resulting Kaplan-Meier curves of the groups are shown in FIG. 14. Comparison of FIGS. 14 to 10 shows that the cases in the medium-risk group were able to be classified into two high and low groups having large differences in recurrence-free survival rate by adding criteria for determining the presence of KRAS gene mutation.

Example 7

2 Improvement in Prognostic Predicting Performance Based on Stratification of Medium-Risk Group by KRAS Gene Mutation Among the specimens determined as the medium-risk group (as the analysis results in Example 5), the specimens having a KRAS gene mutation were determined to be high-risk and the specimens having no KRAS gene mutation were determined to be low-risk. All the specimens were divided into two groups.

Figure 15:
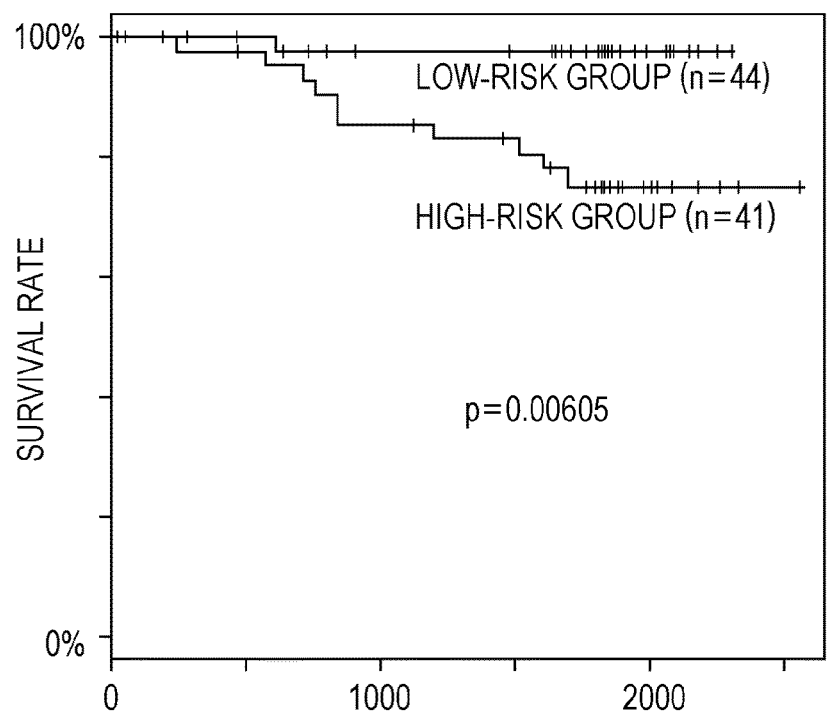
FIG. 15 illustrates Kaplan-Meier curves showing the result of recurrence risk classification of specimens which have been determined as a medium-risk group in Example 5 according to the presence of KRAS gene mutations in the specimens.

The resulting Kaplan-Meier curves of the groups are shown in FIG. 15. Comparison of FIGS. 15 to 12 shows that the cases in the medium-risk group were able to be classified into two high and low groups having large differences in recurrence-free survival rate by adding criteria for determining the presence of KRAS gene mutation.

Example 8

Verification Based on Formalin-Fixed Paraffin-Embedded (FFPE) Tissue

FFPE tissue specimens were prepared from 18 cases of the frozen tissue specimens (85 cases) used in Example 5. The 18 specimens were classified into the risk recurrence groups. More specifically, total RNAs were extracted from the FFPE tissue specimens using the RNAeasy FFPE kit (QIAGEN). The pretreatment of the nucleic acid chip was performed using the Sensation Plus FFPE Amplification and 3'IVT Labeling Kit (Affymetrix, Inc.). The obtained total RNAs were measured with the GeneChip. The genes of Table 1 were clustered in the same manner as Example 1.

Figure 16:
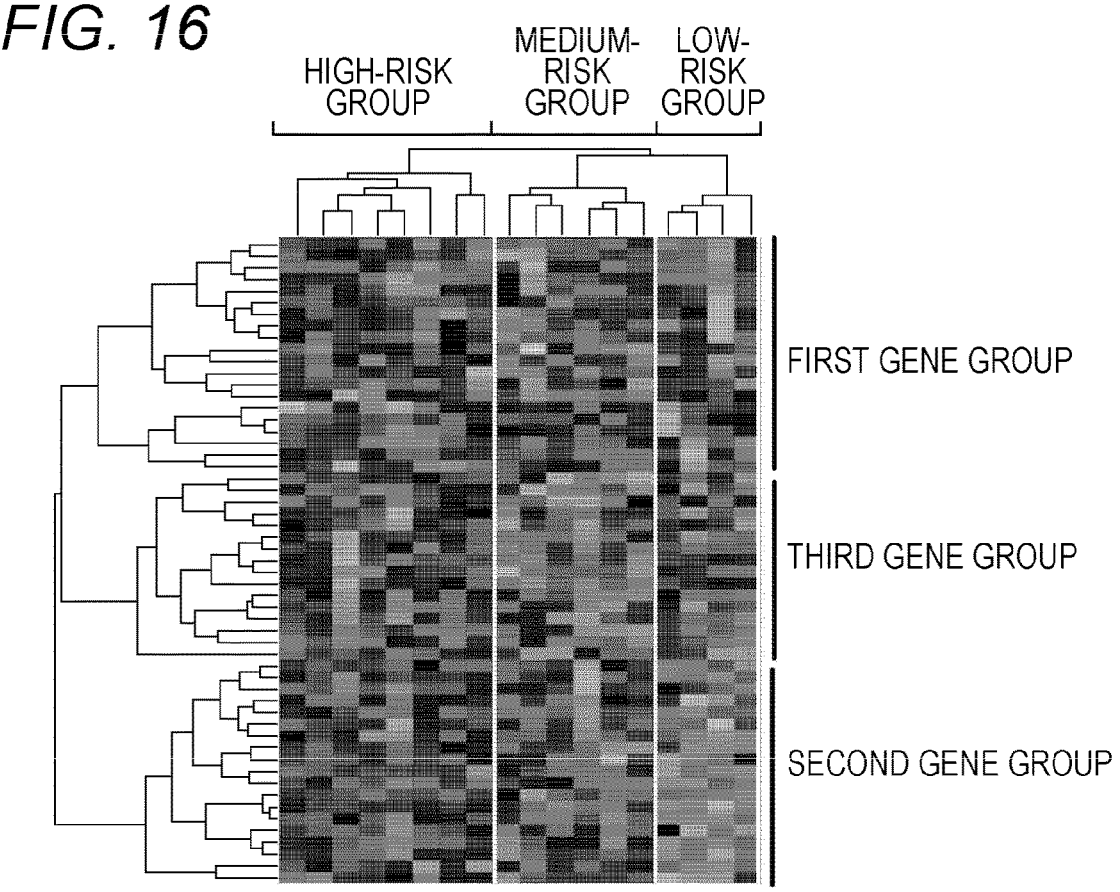
FIG. 16 is a view showing the result of recurrence risk classification in FFPE tissue samples 18 of Example 8.

FIG. 16 shows the result of classification of the FFPE tissue specimens (18 specimens) into risk recurrence groups. As shown in FIG. 16, it is found that when the FFPE tissue specimens were used, the colorectal cancer cases can be classified into the three risk recurrence groups based on the levels of expression of genes of Table 1. Table 8 shows the number of FFPE tissue specimens (18 cases) classified into each of the types as described above (abundance ratio) as well as and the rate of recurrence of colorectal cancer.

TABLE 8

|  | Abundance ratio | Recurrence rate |
| --- | --- | --- |
| Low-risk group | 22.2% (4) | 0% (0) |
| Medium-risk group | 33.3% (6) | 0% (0) |
| High-risk group | 44.4% (8) | 37.5% (3) |
| Total | 100% (18) | 16.7% (3) |

Among all the 18 cases, 4 cases were classified into the low-risk group, 6 cases were classified into the medium-risk group, and 8 cases were classified into the high-risk group. The colon cancer recurrence rates in the low-risk group, the medium-risk group, and the high-risk group were 0%, 0%, and 37.5%, respectively. These results indicate that when the FFPE tissue specimens are used, colorectal cancer cases can be classified into the risk recurrence groups with high accuracy.

Figure 17:
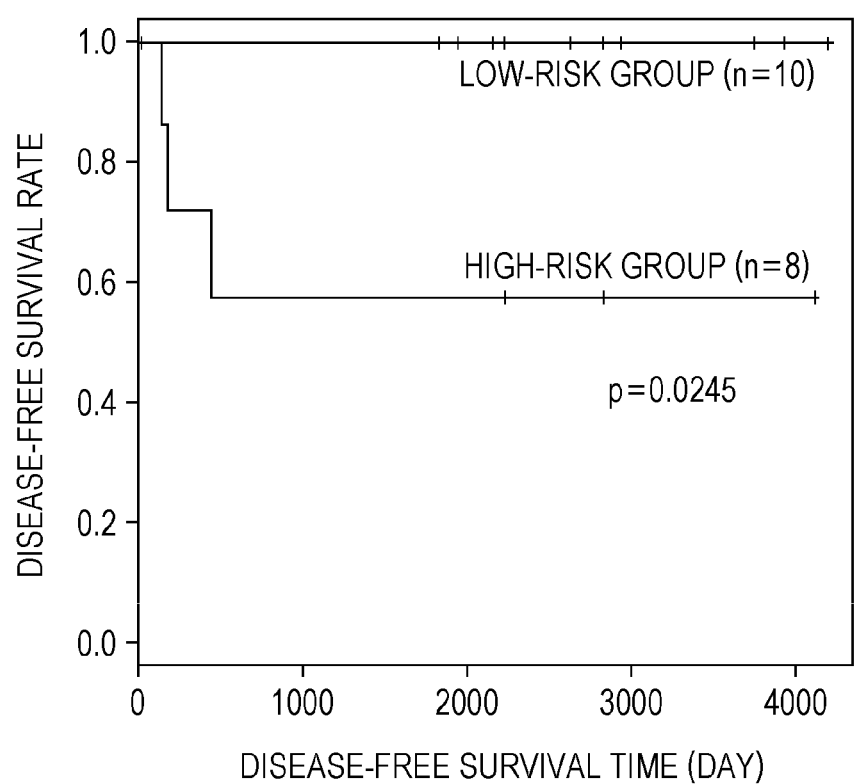
FIG. 17 illustrates Kaplan-Meier curves showing the result of stratified recurrence risk classification of the medium-risk group in FFPE tissue samples 18 of Example 8 according to the presence of KRAS gene mutations.

As for the above FFPE tissue specimens, 6 cases classified into the medium-risk group were subjected to KRAS gene mutation measurement. In all the 6 cases, the result of KRAS gene mutation was negative. Thus, each of the cases was able to be classified into the low-risk group. FIG. 17 illustrates Kaplan-Meier curves of the groups when FFPE tissue specimens are classified into the risk recurrence groups in Examples 6 and 7. As shown in FIG. 17, it is found that when the FFPE tissue specimens are used, a large difference is observed in the postoperative recurrence-free survival rates in respective types.

The results of FIG. 16 and Table 8 show that when the FFPE tissue specimens are used, the colorectal cancer cases can be classified into the risk recurrence groups in the same manner as Example 1. The result of FIG. 17 indicate that, similarly to Examples 6 and 7, even if the FFPE tissue specimens are used, it is possible to improve the accuracy of risk recurrence group classification based on the presence of KRAS gene mutation. Table 9 below shows a correlation table between the determination result in the frozen tissue specimens and the determination result in the FFPE tissue specimens.

TABLE 9

|  |  | FFPE | | |
| --- | --- | --- | --- | --- |
|  |  | Medium-risk group | Low-risk group | High-risk group |
| Frozen | Medium-risk group | 5 | 0 | 1 |
|  | Low-risk group | 0 | 4 | 1 |
|  | High-risk group | 1 | 0 | 6 |

The concordance rate is as high as 83.3%. This result indicates that when the FFPE tissue specimens are used, it is possible to determine the risk of recurrence, similarly to the case where the frozen tissue specimens are used.

Example 9

Method of Determining Risk of Recurrence Using Correlation Coefficient

In the low-risk group, the medium-risk group, and the high-risk group classified in Example 1, the levels of expression of the 55 genes shown in Table 1 were measured. Based on the levels of expression thus measured, the expression pattern for the low-risk group, the expression pattern for the medium-risk group, and the expression pattern for the high-risk group were obtained. Each expression pattern included the average values for the genes.

As specimens, the same specimens as in Example 4 were used. For each specimen, the levels of expression of the 55 genes shown in Table 1 were measured. Based on the levels of expression thus measured, the expression pattern for each specimen was obtained.

A correlation coefficient between the expression pattern for each specimen and the expression patterns for the risk groups were calculated in according with the Spearman's rank correlation. For each specimen, a risk group that exhibited the highest correlation coefficient was identified.

The concordance rate between the results of Example 4 (risk classification by cluster analysis) and the results of Example 9 is shown in Table 10.

TABLE 10

|  |  | Results of Example 9 | | |
| --- | --- | --- | --- | --- |
|  |  | Low-risk group | Medium-risk group | High-risk group |
| Results of Example 4 | Low-risk group | 61 | 0 | 13 |
|  | Medium-risk group | 6 | 116 | 1 |
|  | High-risk group | 3 | 21 | 37 |

Referring to Table 10, the concordance rate between the results of Example 9 and the results of Example 4 was 83%.

This result indicates that when a correlation coefficient is used, it is possible to determine the risk of recurrence for a specimen.

Example 10

Determination of Risk of Recurrence Using KRAS Gene Mutation

As for the patient group determined in Example 9 to have a medium risk of recurrence, the presence or absence of a KRAS gene mutation was examined. In the medium-risk group, specimens having the KRAS gene mutation were classified to have a high risk of recurrence and specimens having no KRAS gene mutation were classified to have a low risk of recurrence.

The concordance rate between the results of Example 6 and the results of Example 10 is shown in Table 11.

TABLE 11

|  |  | Results of Example 10 | |
| --- | --- | --- | --- |
|  |  | Low-risk group | High-risk group |
| Results of Example 6 | Low-risk group | 146 | 13 |
|  | High-risk group | 20 | 79 |

Referring to Table 11, the concordance rate between the results of Example 10 and the results of Example 6 was 85%. This result indicates that when a correlation coefficient is used, it is possible to determine the risk of recurrence for a specimen.

Figure 18:
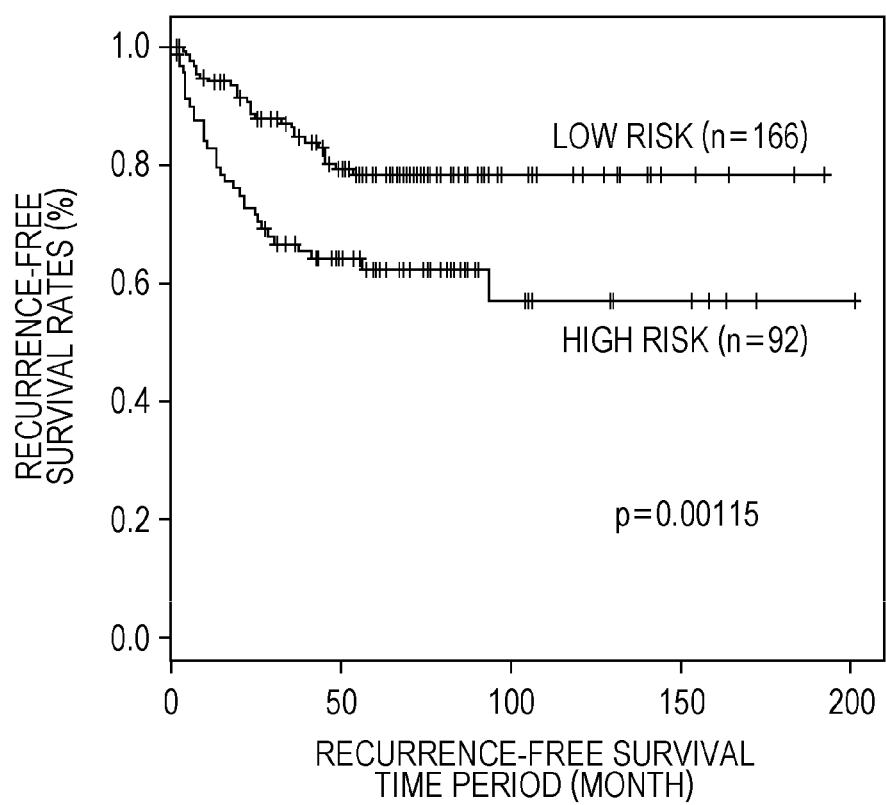
FIG. 18 illustrates Kaplan-Meier curves obtained in Example 10.

FIG. 18 illustrates Kaplan-Meier curves created from the results of Example 10. Referring to FIG. 18, by adding the presence or absence of the KRAS gene mutation to the determination criteria, it was possible to classify the specimens into two groups, namely, the high-risk group and the low-risk group, for which the recurrence-free survival rates were significantly different from each other.

When calculating a correlation coefficient to determine the risk of recurrence, the diagnosis supporting apparatus shown in FIG. 1 can also be used. The flow of processes for this case is described referring to FIG. 19. The storage unit of the apparatus stores, in advance, the expression pattern for the high-risk group, the expression pattern for the medium-risk group, and the expression pattern for the low-risk group.

The reception unit 301 of the diagnosis supporting apparatus 1 obtains information on the fluorescence indicating the levels of expression of genes in the biological sample from the measurement device 2 (step S2-1). Next, the calculation unit 303 calculates the fluorescence intensity from the obtained information and transmits it to the storage unit 302 (step S2-2). The calculation unit 303 calculates the levels of expression of genes based on the stored fluorescence intensity (and the expression pattern for the biological sample is obtained) (step S2-3). Thereafter, the determination unit 304 reads out the expression pattern for the high-risk group, the expression pattern for the medium-risk group, and the expression pattern for the low-risk group stored in the storage unit 302, and then calculates, based on these and the expression pattern for the biological sample obtained in step S2-3, a correlation coefficient between the expression pattern for the biological sample and the expression pattern for the high-risk group (hereinafter, the correlation coefficient is also called a "correlation coefficient H"), a correlation coefficient between the expression pattern for the biological sample and the expression pattern for the medium-risk group (hereinafter, the correlation coefficient is also called a "correlation coefficient M"), and a correlation coefficient between the expression pattern for the biological sample and the expression pattern for the low-risk group (hereinafter, the correlation coefficient is also called a "correlation coefficient L") (step S2-4).

Determination whether the correlation coefficient H is the highest is performed (step S2-5). In other words, when the correlation coefficient H is higher than the correlation coefficient M and the correlation coefficient H is higher than the correlation coefficient L, the correlation coefficient H is determined to be the highest. When the correlation coefficient H is the highest, the biological sample is classified into the high-risk group and the biological sample is determined to have a high risk of recurrence (step S2-6).

When determination is made in step S2-5 that the correlation coefficient H is not the highest correlation coefficient, determination whether the correlation coefficient M is the highest is performed (step S2-7). In other words, when the correlation coefficient M is higher than the correlation coefficient H and the correlation coefficient M is higher than the correlation coefficient L, the correlation coefficient M is determined to be the highest. When the correlation coefficient M is the highest, the biological sample is classified into the medium-risk group and the biological sample is determined to have a medium risk of recurrence (step S2-8).

When determination is made in step S2-7 that the correlation coefficient M is not the highest correlation coefficient, the correlation coefficient L is determined to be the highest (step S2-9). When the correlation coefficient L is the highest, the biological sample is classified into the low-risk group and the biological sample is determined to have a low risk of recurrence in step S2-9.

The output unit 305 outputs the determination result of the risk of colorectal cancer recurrence in the subject and allows the display unit 3c to display the determination result (step S2-10). Accordingly, the diagnosis supporting apparatus 1 can provide information to support the determination whether the risk of colorectal cancer recurrence in the subject is high, medium or low to a doctor or the like.

Figure 19:
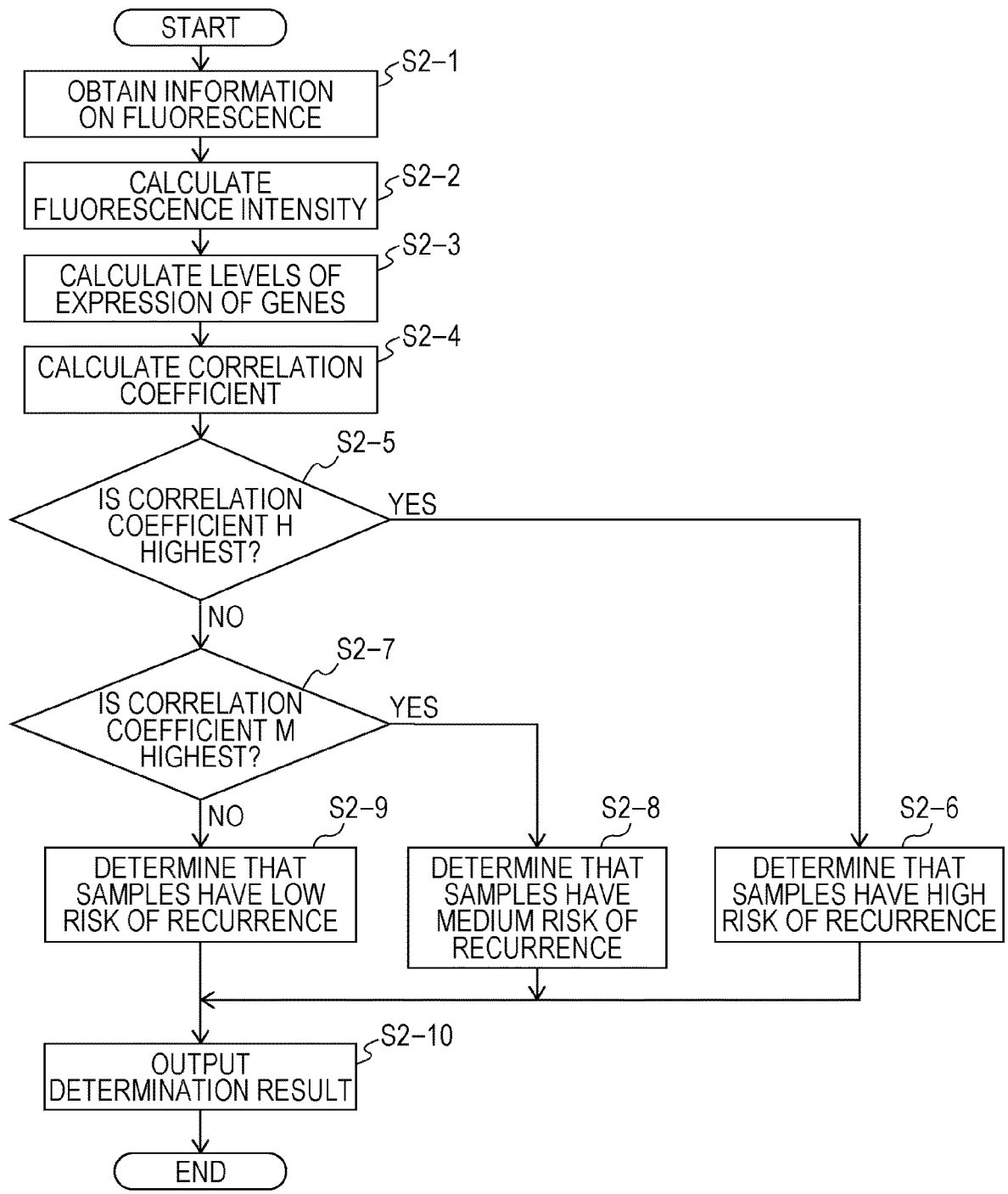
FIG. 19 is a flow chart showing an operation of a diagnosis supporting apparatus.

The flow chart shown in FIG. 19 may include, instead of the step of determining whether the correlation coefficient M is the highest, a step of determining whether the correlation coefficient L is the highest. Alternatively, the flow chart shown in FIG. 19 may include, instead of the step of determining whether the correlation coefficient H is the highest, a step of determining whether the correlation coefficient L is the highest. In either case, determination on which of the correlation coefficients H, M, and L is the highest can be made. In either case, the order of the determination steps to be performed is not limited.

Example 11

Verification Using Formalin-Fixed Paraffin-Embedded (FFPE) Tissues from Colorectal Cancer Patients without Receiving Adjuvant Chemotherapy As a validation set 5, tissues were collected from 37 cases of patients with colorectal cancer (colon cancer) who had not received adjuvant chemotherapy, and were frozen. FFPE tissue samples were prepared from 37 cases of the frozen tissue samples. The 37 samples were classified into the risk recurrence groups. More specifically, total RNAs were extracted from the FFPE tissue samples using the RNAeasy FFPE kit (QIAGEN). The pretreatment of the nucleic acid chip was performed using the Sensation Plus FFPE Amplification and 3' IVT Labeling Kit (Affymetrix, Inc.) or the 3' IVT Pico Kit (Affymetrix, Inc.). The obtained total RNAs were measured with the GeneChip. The genes of Table 1 were clustered in the same manner as Example 1.

Table 12 shows the number of FFPE tissue samples (37 cases) from colorectal cancer patients without receiving adjuvant chemotherapy classified into each of the types (abundance ratio) as well as the rate of recurrence of colorectal cancer.

TABLE 12

|  | Abundance ratio | Rate of recurrence |
| --- | --- | --- |
| Low-risk group | 19% (7) | 14% |
| Medium-risk group | 51% (19) | 37% |
| High-risk group | 30% (11) | 64% |

Among all the 37 cases, 7 cases were classified into the low-risk group, 19 cases were classified into the medium-risk group, and 11 cases were classified into the high-risk group. The colorectal cancer recurrence rates in the low-risk group, the medium-risk group, and the high-risk group were 14%, 37%, and 64%, respectively. These results indicate that when the FFPE tissue samples from colorectal cancer patients without receiving adjuvant chemotherapy are used, colorectal cancer cases can be classified into the risk recurrence groups with high accuracy. Further, comparison of the results of Table 8 to the results of Table 12 shows that the use of the FFPE tissue samples from colorectal cancer patients without receiving adjuvant chemotherapy as biological samples enables colorectal cancer cases to be classified into the risk recurrence groups with higher accuracy.

Figure 20:
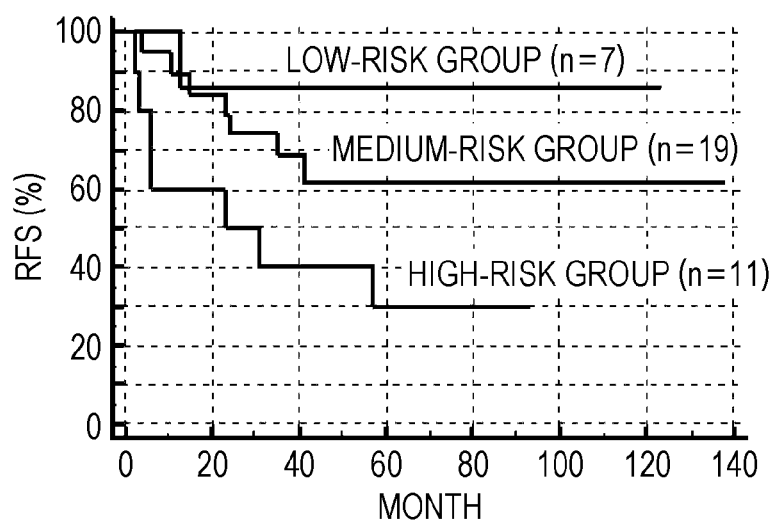
FIG. 20 illustrates Kaplan-Meier curves obtained in Example 11.

FIG. 20 illustrates Kaplan-Meier curves created from the results of Example 11. In FIG. 20, a vertical axis represents a recurrence-free survival rate (RFS), and a horizontal axis represents a recurrence-free survival time period (MONTH). As shown in FIG. 20, it is found that when the FFPE tissue samples from colorectal cancer patients without receiving adjuvant chemotherapy are used, a large difference is observed in the postoperative recurrence-free survival rates in respective types.

Example 12

3 Improvement in Prognostic Predicting Performance Based on Stratification of Medium-Risk Group by KRAS Gene Mutation Among the samples determined as the medium-risk group (as the analysis results in Example 11), the samples having a KRAS gene mutation were determined to be high-risk and the samples having no KRAS gene mutation were determined to be low-risk. All the samples were divided into two groups.

Figure 21:
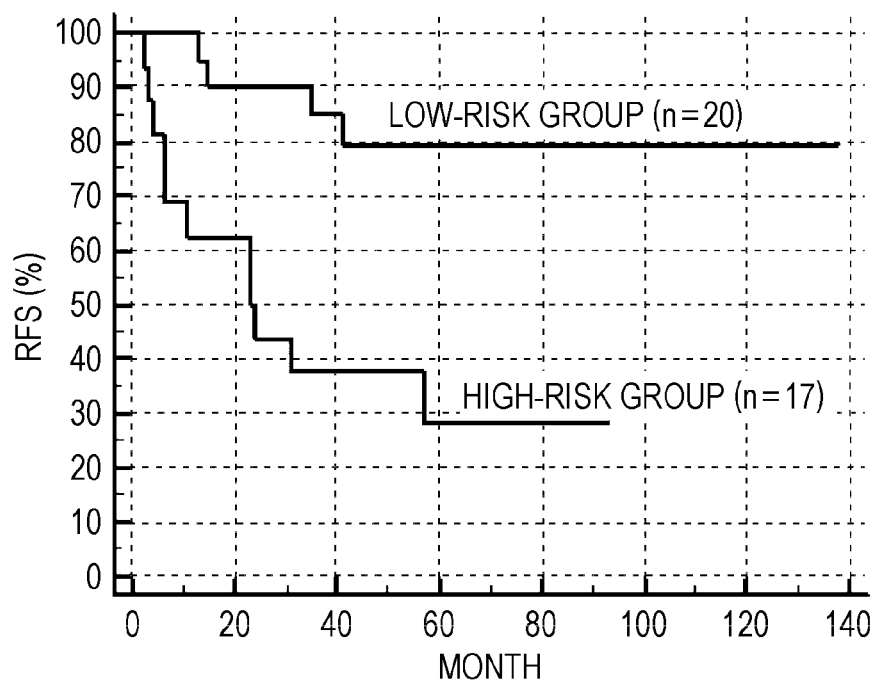
FIG. 21 illustrates Kaplan-Meier curves obtained in Example 12.

The resulting Kaplan-Meier curves of the groups are shown in FIG. 21. Comparison of FIG. 20 to FIG. 21 shows that the cases in the medium-risk group were able to be classified into two groups, namely, the high-risk group and the low-risk group, having large differences in recurrence-free survival rate by adding criteria for determining the presence of KRAS gene mutation.

The p value in FIG. 18 when classified into the high-risk group and the low-risk group was 0.0245, while the p value in FIG. 21 when classified into the high-risk group and the low-risk group was 0.0013. This shows that the use of the FFPE tissue samples from colorectal cancer patients without receiving adjuvant chemotherapy as biological samples enables colorectal cancer cases to be classified into the risk recurrence groups with higher accuracy.

SEQUENCE LISTING (60 sequences)

SEQ ID NO: 1 - DNA, 5679 bp, Homo sapiens
atcgccccgcccacacgccgcctgccaggcgtgagtcttcctcccgctctgcgccgtcgccccgcccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaagaaaatggtaaaatagtgtctctgagatgctggcatggccacctccacctgcagagccctgccaggtgccagtgagtgcttggcccgaggggtcaggccacagcagtggccggggtaagaactgaacctgcaaacctggggagaacagagggtccccagagcctcccaaccccctggagctgggctccgtccctggggctgctgggctggcacgtggcgccgggggctccatccctggggctgctgggtcggcacgtggcgccgggggctccgtccctgactggcctcttcacagctttgtgcagcaggctccaccttctggttcaggccaaggttgggcagaaagtgagttgggtttgctggggcttcctgggcgaccccggctctgaccgtggttccatcacgcctgaagtagtaacacttttcccttggtgcccgtggccagctagtgtattttctaatccatccaaaggtgaaacagacttggtctttgccttctgaagagtgtgcgactctgagtcatactgaattctttgtgtcacctccgacgcaaagattcgttttgctgtttatcagaagagaaaacacagattccataccttgtcagctcctatttagttcggcttccctcttaatgtcccagcccctgtgagctgtcaggttctaaattcagaattctctcaattctgtcaggttctgcactacgagtcagtgtcatccctccaagccctggctctctgccagtgcagcagggctgtgagaatcaagacggcacagggaaggcatctgtcccagcatttgcacatgacaggtgcccacggtgcaggagtagaatctgtggaagcagcagtggctttagttgctgtgccctgccacctcctccccaaaaaggagaagtgtccaagggatagcagacccgtagcactgagcggcctgccgtgctgaccactggatccaggccacgtgctgcagacagcggctgtgggcgagtgatgaggccactacccagaaagctgcatgtgcactgtgtggggtaaggacagtaggagatgctgctgcaagatgctgactcccttgtttttcttttcatttgtgctctgggactaagctgtgtataagtcatcaaatggcagaagcaagatttttcttttgagatctaggaaattatttgtttatactctacactcttatttcctatatcaggatggggaggccactacctcaggccagttaaactaagaagaaagaatttaaggcaatttgtaaggatagacaaaaccccacatgatggtatgagtaggagagagaaaaaaaaaagggagccagaaattaggttacaaagtgtacaccacacataaaggctgatgcctctgttacaccgtgagccaaatgtttatctctagggtttctggtagccagttgcggggtgtccagtgaaggggtgtacatgtctgtggttaatcatataggtcaggataatgaggtgatactgcagtgacaaatggcaaatctccctggcttacaacaaccagtttgcctcttattcttctaggggaccatcatgggctgaggtcaggccaaggccttttgtatctggtgttactggaacatggctatgtgaattcatttatgtacaagagacctccccatcctgatgtaggaaatgaatggtgatgatttacgagcgcaacatcctaaaaaacgtttttgtatttccctagcaagataacttcaggttacaaggctctggtacttgaccatgatgactccatgagaaaacagcagaacgccagctttgcaggtacctccacagcactgccgggctgggaacagggccagtgcttgcaccagcgctggagggggccacagcagagtaaagacagagtctgccatgcaggagtgcttcgcaggtcaggcactgctctgagtgctttgtgttaacctgccccccgccccctaacttgggaaaggtgttaaagaaggagagaacgccctcaatggtgtgtcctttgcatacacacctttgcatgcatctgatgtgcccaggctgtgttttattgttctagcaatttattgttacaaaacagattgctgccatcaatttgtctcaggtccttctagcacatctgacagggactagtgtctagagccatgaggacagagaccagaagggacaagaaggagtgggcagagggaatggaaggtagagttaggcccagagagccccaggctgctgcccagacctccacgcctgtgccggatgtggtgttggcatccatagcagtctcgcaaagttgttctcattttccaaataaggaatctgaggcccagggagaggtgaagtgctgcaggagatccaaccaggcgccggctcagtgcctcctagaaagaggagtgtgggcacgtttgcaggggatccaaccaggcgtcagctcagtgcctcctagaaagtggagtgtgggcatgtttgcaggggatccaaccaggcgtcggctcagtgcctcctagaaagtggagtgtgggcacgtttgcaggggatccaaccaggcgtctgctcagtgcctcctagaaagtggagtgtgggcacgtttgtaggggatcccaccaggcatcagctcagtgcctcctagaaagaggagtgtgggcacgtttcagagaaaactggcttaggcctccctgtttctggcgtggccttccctgggagcgagttagggacacggaagctcacccgcttctgaatgggtccactcctggggatttccgcggccttccctgggagcgggttagggacacggaagctcacccccttctgaatgggtccactcctggggatttccgcggccttccctgggagcgggttagggacatggaagctcaccctcttctgaatgggtccactcctggggatttccacggcctttcctgggagcaggttagggacatggaagctcacgcccttctgaatgggtccactcccggggatttccatggccttccctggatgatccactcctggggattttccgcagctctccagatgacgtgcacgcacactaaacacccagaagttagggaggcactgatccagtgaagtcctcagatcaaccttgtgagctttttacaagtacctgtcactgttaaactgctgatgaaatgtgaaacgacttcacaggttttcagtctgataagctctcctgtgtcactgtcccttaccttgttagtaaaggtcaatggttctcaaagttccgggcacatcccctgggggctcataaaaccagactgtcggccacttcagccttctggttcgctgttccttggtaatgcagatggcccagtaagcaactctacaaacattagaacattttgaggtagacaggggaacttaatcaccccttgtaggcccccagaagactggacccaacatccagcacaatgcctctcagccttggctgtgcatctgaaacacctgctgtttgaagacacctgggcctggagacgggccagagccaccttggtggtctgagtatgaggccagcattagaacctctgctctacgggtgactgccctgggttgatttttttccagtattatctttagtacagaatcttttcctctctaagggcctgagaccctctcttaggaatagaagtacagttttcttccccactccttttgtccagaaggaaaacctggttttacatcagaaacttgaggtactttgaaaatttgccagctgccttgaaggagagagggcttgagtgtattttgggggaagaatgaggggacaacagggcagggagaagggacagagctagaggaaggacaggcctgtgccacccaggccagggtaaggggagcagagaccttttggttcctggtttgtgacacaggaagggagggaactggggaggacaggtcatgatcagtgtttcctgattaaaaattttttatttttatttttaattatcatgggcacagagtaggtgtatatatttgtggggtacatgagatgttttgatacagacatgcaatgtgaaaaagcacatcatggagactggggcacccatcccctcaagcatttatcctttgtgccacaaacaatccgattatattgttttagttatttttaaatatgcaattaaattgttattgactatagtcacccttctgtgctgctgctctactgtggcctcaaagatcataaatgctgtgggtgctggcaagatactgaaataaattaattctgtatttctaaaaat

SEQ ID NO: 2 - DNA, 1327 bp, Homo sapiens
cactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatggggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttaaaaaaaaaaaaaaaaa

SEQ ID NO: 3 - DNA, 4136 bp, Homo sapiens
ggggcctcaccggcgccggactctgccctgggcgcgccccgcggggcggagccaagcctgcgggcggtggcggctgcactcgcagggccctggcagccgaccctggccccaaggtccgatcgcccaggggaggagcagcaccgggaccccgcgtcggctgggcgccccacaagggaagccagtcttaatatgatggaaacatctctgaacttctaaaagaccaaggttggcgttttagctctattaattttacttcgtcttggccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaaaatcaaacaaatctatatttaatggatggactcttcaaaacttaccaaatagttgaagaaaccaggtgccttctcatgatggaagacagattctgctttaaattaaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttacgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctgacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgctacattgtgtgaattgtttggttttctttttatattaaaattatgcataaatgaaaaaa

SEQ ID NO: 4 - DNA, 5089 bp, Homo sapiens
gtggcgggggcgtggcgatgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctctaaaagaatcgctccatctcagttgctcgtcgcgtgcacaccatgcttattgagtggtgtctggttggtggtgtcagctcagggcaggggacagcaggcaggacccggaaaacagaacccaggtcttcccaggcgagcactccctccctcgtccacacaagtggaggctcactcgtggccccctgcatgttccgagaagtgtccctgtctctgctccttaacggctgtggggccacaggaagtccagctggcttaaacaaagaattgattggcccacttgacataaaagaacagagtaaactcaatgaaaggaaaaggctccttgaagtggttggttccagggctgggcagggaagatgcaagatgagtctggaccctctcacatcggaacgtaaggatgcgctcctgagggcgtggggctgcgtccaaggacacaggagccagcctggaagagtttgcaggggcccaggggagcaattggagtgagaaaatagcagtagtgttggatttttaccatggaataaacaacaatccatgagtccatactaatataaataaagtgacaaagtgggtgagaaggaccagtgcccctggatgaagaatctctgctcatgtgggaggaaggtgggagatcaaagctggagcacttgctgctgcaggtgagacccctgacacactctcaaattggtaggcaaaggtttaaagaacgggatatttgcttagcttaaaagcacctcccaaggggaaaacagtaacttcacagtggagagacctggcaggcaccaccctcagatcaaaatgaacctcagcagtaatgacacgtccacatcagcacccccaacaccactccctgaggaggacatgccagttctgggaacatcacactcatcgtgacaaaacatcagacaaacccaaacggatgaaatgtgaggaaaatctgtagttggttttacgtggatgttaatctcttagttttgatcattgtgctgtagctgcataagaggttagctgggtgaagtgtatctggggaccctctatggcttttgcatcttttctctaagtctcctgtcatttcaaagtaaaaacaaaaaaagaagacaagggtagcggcttcaggtacagctggacccagcactcagtgctatctgggcttgtggctccaactcaactcctccatcagaactgtgagaaatgcattctttcagcttctaatcctgcaaaaagaactgcatggtcttcccccagaaatcctaagagtagctgctggtgtctcatgcatgcgagctgcatatgggcccccgttagtcaggaacccatgctgagaggtgctatgctttgaatgtttggctcctcccaaactcgtgttgaaacttaatagccattgtaacagtattaagaggcagggccttcaagagctggtcaggccatgagggccctgtcctcctgactgagtgaatgctgttattgtaggagtgggcttgtttggcctcctcttgctctctctacccctctctgagcccttgtgttgtgggatgacacagccagaaggcccttgccaggttccggtccctccaccttggacctcccagcctcccgaacgttgagccaatacatctctgctcattgtaaattacctagtcttgggcattgtgttacagcagcaaaaagcagcctacggcagtcaccgtgctaacacctgcagcagcctgcggcggtcaccgtgctaacacgtgcagcagcctgtgtggctcaggccagtcagcttcccctggaagcaagtgtgaggtcgtcgcctctggaagtgctagcggagggtgatctcccggaggaaatcagagtggtgttctactagaaggccgatgactcctgggtaaagtgccaatgctcacctccatctctgcaagctcagtccctcgtggaatttccaggagcacaagggcaatctcgacagctccacgttcccagtgcccgacccaagcctggcccatgatcagataaatgcctaagtggggtggcatggacatttgcacacgtccagactgctttatgttagaagctgagctggcatgccactagctggttttgatgtaaacaacaattttgtaaaaccctggactgaatgggtctgactaacggctggttctgtgaacttgagcctcagcgtcctgtgtcagaagagcacaaaccactttcccagagaggttatgaagacagaaatgaccctgtgacccctttgcaaagtatgaagaacggttcccactcatgcatggagctggatcttctcaagtgggaaacaggcgtggtaaataaatactgttgtttcagctggtgtaaaaaaaaaaaaaaaaaa

SEQ ID NO: 5 - DNA, 743 bp, Homo sapiens
cagccagctcgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggccgagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaag

SEQ ID NO: 6 - DNA, 527 bp, Homo sapiens
tttttttcatctttatcattattttattttagtaataagaaactggggctcagaaagtttaggtaacacagtaggaaatgatgaaactgaaacaagaaatcatgtctatttgattgcttttttcctgtaaagacagtcattaatgctcttcaccaaatgttttcatttcttctgacacatgccaagatcgcacttccccatccttttgaagttacttgcagccatgataattgccctggcccaatgcaatgtgaacaggtaaaagacatattttacttctgggccaaagcttcaagaaccagtgcatattttgttgtcttctctctctctaatgcagataacagaagtcccatgagcctgggtcccacaaagagacatggagtgtagcatccagcaatgtcgttataaacttgtagtgggaattaacaatacacatttgttgttataaactaagatttggttataaaccactaagcataacctagccactgctgactgattaattcacaaagtggctatatcacttt

SEQ ID NO: 7 - DNA, 1056 bp, Homo sapiens
gagctcatgctacacaattaaatatattccttaaatattgtgtgcttgcaacttttgattttgtaaatgggttcccacaggacaaaaatgagtcttaaacataaaattaaaccatatgaatgttagttttttagttaatttcagctgggtggtagtctatagtcccagctactcgagaggctgaggcagaaggatcgcttgagcccaggagttcagggctgcagtgagctgtgatcacaccactgcactccagcctgggggaagagcaagaccctacaaacaaaaaagagttaattccattatatttatttttacatacccagagtttgactaaaatataccagacaatctcctgtccccaaatccatgtccaagcaaggggagccacgttttctaagctcacagtttaaaggttaaagagacacactgaggaaaactcagggaaagaagctgatttgcatggacactaggcctgtcgttgattccctcatttcaaaagttgcatgtgccatgggaggcggagtctctgaggacatcctggctgtgcctcggtggctctggactccagctctacgcagagcgccttaacactgtactggaagaaatgggaaatcgcattgaggacttacagaagaatgtcaatgacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaggagacgcaaggggctcgcctgctctccccccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaactt

SEQ ID NO: 8 - DNA, 1965 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaaggaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacaaaaaaaaaaaaaaaaaa

SEQ ID NO: 9 - DNA, 596 bp, Homo sapiens
ttctgttaaactgtttaatgaatgcataaaaaggcagaaaaatatataaagccaaaagctcataataaaattaaatcatgatacaaccaccacaggcaattaccatcaaatacattcccatgatttacaaatgtatcgcttatacagaggaagttgcaaaatcactgccagtacagacacatccagtctaattaactatcgtctattcatacaacagcaacaactgcagctcctgagaccacagaaggacacagtgagcagctggtgactgagccagggtagcctccgatcaataactgatcagagtaatgagacttcgagaggaatgcctataagaaatctcaaaaggtatttgtttgggtgcagaaacaaatgcaccctccacatttggattttctctagaagaatctgtggccaaatctcttatccaatggagggtactgagtggctggatcagttaccatgcaagctcacgatgaatgagattgatttgggtcgtgtgccactgggctctggggagggaggaaccctgtgtgttgctgctgccttccgtgctgtctactgatcctcatgtgtcccaatggtacacgcccctg

SEQ ID NO: 10 - DNA, 740 bp, Homo sapiens
catatttcaagtgtttttattctgagcagtaggtacaaaaaataatgacatagttgtgtctaattctgtatagttcagcaccctccacaggctgtcaatctcgatttgatctacttttaccagatttaacagatccttgaatttactttactgtatatacttccttcttgctcacattgggaatcaaactaatgctggaaacatgcatcttcagacttcattgaggaattccagattgagacacgctgggatgtggattgagtccatggtttgaggaagatggattaaatggaaacaaaacaggaaacatgtgcttggcatctaatagcagttgctgagggtcattccgctcttgtagttgtgcctggattgttcgtataaaggccactgttacccgttcttcaaattcattcaggggagtataaaggtttaaaattttgacaatctgctgggtgctgagggaggtacacagggagcagatagcctctgcgtcctcctgggttttcttcttaattgcaggagctgggctgcttggatcagaggttccatggtctgaactgctccactctggtgaaggtttcttccccgaagccactcctcaagctgacttatattgtacctgagttgcatgcctgtgctccaagagcagacgtccttccgcaagagcaggttggtagagttactgcgttgatcatgtggagagctgttgataccttgaggatgatctcaggtgcaagccc

SEQ ID NO: 11 - DNA, 2868 bp, Homo sapiens
atccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 12 - DNA, 2565 bp, Homo sapiens
ggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgaaaaaaaaaaaaaaaaaaaaaa

SEQ ID NO: 13 - DNA, 941 bp, Homo sapiens
taaacatctaagtaatctgactattcttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgcccttgggctctgatttacaattatcagaaggcaaaaacagctttgaaaagcccatcagtaaaaagaagagtggatgaagcatactccttagcaaagaaaactccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagtgacaactttctgtgccttttcctttctgttgaaaaggcatagaaagttctgggaacataaacatttttaccttctctatgcatttatttgtaaaatctatttaaagttattaataaacagtattttagaaataaaaaaaaaaaaaaaaaacaagaaaaaggggggggcataaaatatcctggaggggacaaattagcgtaccagttttgagaaggggccatgggggggaaaagcgggaggggtaaaggggctggaacgatcgggcttgaggccctcggggacatggaccacggaaacggaacatatgttgtgagttcgggatgggttatacagg

SEQ ID NO: 14 - DNA, 794 bp, Homo sapiens
ggcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaaaaaaaaaaaaa

SEQ ID NO: 15 - DNA, 582 bp, Homo sapiens
ggtgaacgaaattttttatttacacactgtatctagaagcagatacataaattcttatacaattaatttccaaaaatgtgcaagaaattactataatttgtttacaaaccaaaacacgtattaaaatcaatggactttggataattcattctgtggtgttctcagtacaaatggtacacacctgatttgaaacatacagaaaaagtgtaactaccgcaatctgaattgcaagtattaatttcatggcactccaacgactatgaaatttctttcacccaacatgtaatacttgttacaaaattctataagaatttttcataatctctggatgtagagtttggatcacttttcagaaacagcaactacacacttcgccatgttatgactgattaataaaaagaatgttttaaaaaccctccttacggattaaaaaagtttttaaagaaactatttgtgatggcaatgttccccccttttgaaattttaaatttttttcggaaccgggtttgttccctattaaaatttccaaaaaaccgtccatgggggggtggtggttccctttggaattaaaaccccctttag

SEQ ID NO: 16 - DNA, 514 bp, Homo sapiens
cagctctttcactgggtacccaggctgtattttaagaaatttttgtgaaatcaacagcatatatattattaaagcaagtattttctgtccctagtctgtggtccagggaatgagcaataagatacaaatgaacggttgacaccataccataaagattaggaataagcatatcataaagattagcaataagttggatcatgattttacagtgagctcggttttagtaagccataaaaaggattttatggtgaaacataagcttaatataatctctttatcatgttccccctaataactgttcattactgcttcagttcattttgtttacacttgtcacatacatctctacagtacacagacacagacttatattttctatacattttttagcattgagttgcctttggatcaatatagaattagtagggatcagtgcaggaaataatattacctttttctgaaagtagagtcttacttatgtatatagcacctttgatttaaggatctcaaggta

SEQ ID NO: 17 - DNA, 1329 bp, Homo sapiens
tggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaaaaaaa

SEQ ID NO: 18 - DNA, 1415 bp, Homo sapiens
gtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaaaaaaaaaaaaaaaaaaaaaaaaaaaaaa

SEQ ID NO: 19 - DNA, 3337 bp, Homo sapiens
gcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataacctattgactgtattctgtgtattattctttattttgggaccttctgtgtaaaagaaaatattacctaaattggttagatacaaagaaatcattaaaattattaatgtatatatgaaaaaaaaaaaaaaaaaaaa

SEQ ID NO: 20 - DNA, 4701 bp, Homo sapiens
tagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttctacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggcattgtttccaagtcgtacgagtgccgtctaaagggacaaggagccaccttcgtggagacagacagccccttcaccgcggcggccttggcagaagagcccctcgtcaaggagaagcccctcagaagcagcaggaggccagcgccgccccctgagcaggtgcagcaggtcatcatcttccagggctacgacggggagtttgccctggacccctcggtggaggagacggccgccgccacgctgcagacgctggccatggccggccaggtggcccgggtggtgcatatcacggaggatggccaggtcatcgccacgagtcagagcggggcacatgtaggcagcgtggtgcccggacccatcctccccgagcagctggctgatggagccacccaggtggtcgtcgtggggggctccatggaaggccacggcatggatgagtccctcagtccaggtggcgctgtgatacaacaggtgaccaagcaggagattttaaacctctcggaggctggagtcgctccccccgaggcatcctcagccctggatgcattgctctgtgcggtcactgaattaggggaggtggagggcagggctgggctcgaggagcaaggcaggcccggcgccaaagacgtgctgatccagctgcccgggcaggaggtctcccatgtggctgccgaccccgaggcccccgagatccagatgttcccacaggcccaggagagcccggccgccgtggaggtgctcacccaggtggtccatccctcagcagccatggcctctcaggagcgggcacaggtggccttcaagaagatggtccagggcgtcctccagtttgctgtgtgtgacacggccgcggccggccagttggtcaaggacggtgtcacccaggtggtggtgagcgaagagggtgccgtccacatggtcgccggggagggtgcccagatcatcatgcaggaggcgcagggcgagcacatggatctggtggagtccgacggggagatctcgcagatcatcgtgacagaggagctggtccaggccatggtgcaggagtccagtggcggcttctccgagggcaccacgcactacatcctgacagagctgcccccaggggtgcaggacgagccgggcctgtactcccacaccgtgctggagactgcggactcgcaggaactcctgcaggccggggccacgctaggcacagaggccggggccccaagcagggcagagcagctggccagcgtggtcatctacacccaggagggctcctcggccgcggcggcaattcagagccaaagagaaagcagcgaactccaggaagcatgagacgcgcggcacctttactcagcacagggcaggtgtgggaaggtccagcttcggtgggggaccgtgttccctgagcttcatctgaaaccttcaaaaccatgaggacaaggctcccgtgagctctgagcatgccctcccagcgagagtcacactggccaccagccaggcgcccacagagggtaccgtgggctgggcctcggggagcaggctgccaagtgcaggggagggccgggcgcaggccacacagggagctccggtccactgggggcccttcgatcagtggcctcccgcttcgtcctggccgctgtgctgaagagaagccaagtgttgttggtgtttttctctcccaagtgttttcccatttcagttatcagaaggtcatggccgtggggaaagtggtgaagatacccctcgtggcttggggtgcacctgcttgtgcagtcagcatgtagctgcctttccatttcattctctactgggctaaaaattgcagctacaagtgttaccatcttgaagcagtccacttccattcaattttttttttttaattttagaataacagtgtccccataccaaaggaagcctgctagctcatttcatgtataaatttcccatcttcaaacagtttaggtgtatttgttgctctggtcacattctgcataaaagaaatcctcttaagcctatggttaagaaaagccttgaagtttatattcagttaaaatatatgtcggtggagatagccagtgcttctaattttgacttagtttcatacagtaaagcctaaatgtgaaacgcacacgctggaagatattgttcctatcaatattttgctttttataacaagggtttgttcatattgatgccatttttgcaggatttcttcgtgatttctgtccatatgaaaatgctgacattaaacattaacacatggagaccgtgccctgtggccctgccgtggctgccagcatggtctgtgtttccttgtggattcacctgtggccctgctgtggccaccagcatggtctgtgtcctcgtggattcactgcagctgtcggatgcgagtttctgtcataatcatttgtttcctgatacaattgttcttattcttttccaaaactgtaaaataatctcctccctcaaatgcaaaggttgtttttgttctgtttctgttttctttgaaataaaattataacgttaaaag

SEQ ID NO: 21 - DNA, 633 bp, Homo sapiens
tagagaaggagattacaccactttaatgcaatgatgctgaagatgtaaaattaggaagagacgttcatgttctctgtacaatacatccatttacagaatcagccagtactgtgtacaacatataaatacatgataaaacattagaggtgcatagagcatacttacagaagccaaaaagttcactttatacatccaagaataaagagttaaaaatataaaaataagaaacacacactgctttgaaatgtaaaatgactttcacatacacaggtgcgtggagatgcccactcccatagggtccaaagtgacagggaggatgtcaagcagaggaattcacctgcaaacatctgggacggctgactcacaaggtctacagatgggcttttcataggaaagacaaccctattcccccaccccattggtccaagcagagtattcaaggttccaaatgatcccgtggggttaagtggatcccctggacggaaagtttccaaatttgcttcgcaacagaaccaagtcaacttgctccgtcactgggcaatggctcactgtggaccgaggtcagcaggtgcacagccccctggtggcaatgcgggagttactttaaccgtgctggttcttcctggccatcaa

SEQ ID NO: 22 - DNA, 118873 bp, Homo sapiens
gatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgcagttgtggtctcagtcatctgtggctgcctcgctggtgtgggaaggtcagctggagtgctgagctggaagggaaggagtagacgccagctctcctcaccttggctctggagctactcttcttatacttggagctcttcttttgggaggttagtccaaaaggaatgacttggcagcttcactggtctttagccattcatgacttggcggacttcaccacatagactgcagtcagcgttctactgagagcaatgagaatgtttccccttgggagtgcgagtcacaaactgtgacatccctctgcagcaactcatccaaacagcttcactgaggttgaggttgccaagtggcttcctaatggttagtggtcttctgtgggagggtgactagctctaaccttggaaaaccttaaccacaagcacctctttctgtagcctctggtggcagtgagaggaaggtgctggcccagggtggggtgtctgatgctagttgcgtgagcctgagtagacgacgtgcttcagggattgacttcttgagaagtcctcagacgtctctagagtacgtaaatacattgactttgtgcttatcagaaataattttattagtatataaataagccaaaacagcaaaatgatgggagtttaaacatatattcattaattttttcctgtgaattggaggaaaaactttgtggtgggatatcctttggggagttcaagctgccattttgtattgctgccgtttgatcgacatgcagttttgagaattgatggttcggaggccctgtagtgactgagcaactgcctgctgttggtgatatgtccttgtgtcacagaatccatttgcccacttatgtctgcaggagctcagaatgcattacggtcccagatcgggaccttccaatgcctgttgcctctcctcagggaggcagaatggtgtagtgagttcctagagtatagcctctgcgacgtgccagctctgtgttcttgggccatgttatttaaccaggctgccaactctcatatatgaatgggtgtaatagttcttacttcatgaggttgttagtgcctgccacctaggacataatgactattagttcacagcaggccaaggcaataattgttaggtgaacttatagtagaaatctatacagctactgccagctacttcactcttgctccagaaaggagctgtcaggatgtaggccttgtgcccactgcgctgaggggtgatgcaggctgtgaagtcactttggaccctggcttttggtctcaggccacagacctgaccaaaggttgagtgtagtcctgagtttagactgaatatttggtcaggaaggcttattttgctcatggtccaaaggacaagggaaataatgtttcagaatataggaagaatggtactggcctggcaaggtgtcatttatttgctatccagcctgctgtaagactgtgttagagtgtgtgtgggtatgtgtgcatgctaaatagagctgcctgcatccatcaggggtcttgatggccaaagcatctgcctgccctgtctccctgagaggaggggacccaggctgtgttgccctcgtgtgggtgttgtttgaagccatagaagtggcaggatgtggaactttggagattgctccaaaattggacaacacccctatgcttcctcttgtctctggtcaatttgaaagcctagaatgaacatctctaccgtaagccatagacgaacgccctgtgagaacaacagttgtcagtgctgtgttacctgatatgggtgggtcttaacctttttttgggaactctccccccatggaatgcacatacaaagttttttggggtttttttgcagactctcactctcttcaggctggagtgcagtggcgtgatcatagctcactgtagcctcgaactcctgagctccagtggtccttccacctcatcctcccaagtagctcaggctacaggcacgtgccaccatgcccagctaatattaaaattttttgtagagactgttgcccagactagtcttgaactccaggcctcaagcgatcttcccgatcttcccgccagcacacctggcctcacaaagttttgcatactgtgtcaggatttaccagctccttaggcagctggggccctttgtttaagaaccactggctgagaataaacctaataaaatctgtgtttatacaaaagatcaattaagggaagataggattttgcagagattcttcttgcaaagaaatgtaactactaagcttccctagtgcattttaagttggaaaaatagcatatgcatgttttcctatttttcataaagggaggtttgcctgttttgtcattgaatacattttagttcactcttctgaggggacattcccatttgatgaagtcttttatccactgttaacaacagtggtgcggagcccccaaaggagccagactagaataagggagcacttttctgccctcaggcaatttctcctgggaatctcagtgctctggtggactgcagtatttcctgtggaaggaggtaagtgtttgcagggctggccagcaggccagcggggtccatgttctggagctgttgtcacaggttgtgggtttctaatagtcttaatagtttgaggagtctcagtggtgatcatttgaggcaggagaaggaatttccgtggtattaactgaggatttgctgcccctcagcaaaaggaaagcggcaagggaggtgtcaagggccatcgtcttctggctctcagtgagtctcagccccaaagtcatgcccttctccattttatgtatttggctactgcacagactttctatgagaaaaaggattcttatgttatttaaaaatcaaggttttaataactgccataaatgtgtatacatatatatgtatatatgtatgtgtgtatatatgtgtatatgtatgtgtatatatgtgtatatgtatgtgtatatatgtgtgtatgtgtgtatgtatgtatatatatgtgtatatatgtatgtatatatgtgtgtgtatatatacacacacacggaattttagcaaatgtatgcttttaacatgcctaaagttgtttttaaatccatgatcatgttggttcccagccatattcctaccatttttccttaaagcttaacctaaaccatatatataggatgaaaaaaaattagcacaaataagtatctttgggaaaagcagcccttttgtttccttcaaggtgggatccagggttttgcatagaatggaatgtgcagcactgaaggttcagaaccagggatcatgtttgctcagttttccaaactagcacttagggattgttatgggaatttggtttcagtcagttggccatgtgctagggtgagaggttgtggaaaagctacaagttttttgctggtcactgaatttcagcaaggcgtgtaccccgtgtgcctctgtgtctgcacgtggcgggtaagggaactgagatttaaaacagtgcatgagagttctgcctgtgctcagcaactgaagggcacctgggaaaggttcatttccttccctttctaacagatgaggtgctggaattacaggtttatttgttctagaaaatgtactgaggaccttctgtgtgccatactattggctaggaaaaggtggaatctactagtagaaagatgtttcggtgcccaactagatgaggaaggatgagaagtggcaggcggtgctgctgttgataggacacagtggaagcagagcattcggtttgttgttcagtgtttattaagtagattcagtcttatatatgatatacagattcaaaaggaaaaggattccacatacttatgaaatcagtgcatttagcaagtaataccatggagataacagctcgattaacagctcattggtcttttgttaagtgagggagagagggagtcggcctgtgctagtcattccacaaacaaaacagaatttagtcacatcacgtagagaagacacattctaagaattaaaatattaagccacatttactggtaaaactcactatatagaacacaaataatttttatagagagcattgaggaggaagtcctcacctgcttagaagagccacgttaagttgcataggtgcatatctgtaaaaatataatttagaggtgaagccattaatagagtcacctttaaaagttggtgccatccactgtttgccttaagtgcttactatctggagccctgtgcccctccccggaggtgggacctcatgaaggagctgcccccagaggaaccctgaagaaatggcttgtactatctgcactgaaagtcttaaatctcatctcagatatggaactcatgctcttccaaaacatgtctaaattatgccagaggactaaagacctcttgggttgtccctaaatcctggatggcttgatcctgaaggcaacatgagtcattctgaccttcccactcccaggctgcccagggaagaactacattcatcccacagctctgcagcaaagtcctgccttcccttttcctctgtccatgcagttacccaccagcagccaataagaggtctctcttctgactcctgctcctaaatggaccacataattgaggcatatgggccatctaccaggtggaaagtgtttttcagccaatctgagttctacgtggtataggttttttgttgtatttttaggtggaaacgtaggtaaaaagtgagaggtttttgtttgtggctttgctaagcagatgagcttagtgaggtgcatcttcctcctcaagagcaagtcttgcagaacacacagggactgggggcatctgtacatgtaaacagtacactttcactgagtccaaaattaggagcaaaaatacaaaggttcacattggtcttaggtagatacaggcgaaaaaggattgagctgtttagctcagaaacaacaaaaacaaagtttctaaagcaccactaaattatataaaaatcagaccatggacggattgaaactggtattctggtgaaatactttactattttgtaaaaagttttacaaaaaattacaaattaaaagtatcaaccctctgagttcaaagcagcattttgaaaatgaactggtagttaatcctgtaaccacccttagagttgtaagtggcccttgggaatagggatggatgggttccacctgtttgaaatcctcgaaaaccctcctaactccctgcctgtccccctccccgtcagcactgtccttgggaataaactgtcctttgtaagagtggtgacggtaaaatgaatttcagatgggttacacacactatcacttgtctacctgatgatccaccactaagaccaatgcccacttctctgatgctacccttcttgtgggattagcctcctgcaaagactctggaattggagtatcctactcttgcatttcctttttaacttaggatcccaaatgatcactttgtgccctgaggcccttcagaagatttttaaatggctgtgggacaagggctttgggagctccttttgggagaaggcagtccctctggtgagggtgagacagcagtgagcttagttcatcagaaccagctctttggtgccctccaagtcgggagtagggggaaggggttgaagctgcatcttttaaaacaaaagcaaaacaagttccctgactgagccagctaaatggaatcctgtttccatgcagaaacttgctcctgattctgccatctctagggcttcaggtgtagtttcactggaaaggaggagcccacccaagaggtggggtcgacatgatgaaatccattgtcctggaggggcctgggaggcccaatggactttaacaacatattctttcctttctcttgaaaacacattgaacctacgctcttgccgcagtactaaggcaggctggagggtggtcagttccaacagcttgaactcagaaaaacatgacttcaaactgtagcttatgctgatctttagatctaatccttgtgtgggtagggggagggagccccttccccagtctttctcactcctgtctgccaagaaatgcaaacggttcatgtctagcttgggtactgcctctgggaggagaagtgacacgttaagtaactgataccaggaattctagggtggcgattgtctctgccaggttttaacattaagattttcacaaataattgcctggggtaacatttttgcaaaagatcttactgattactttgtagtattgttcacacacaaaaataaatatttacacgaattcaaatgttgagtagtactgagcaggtggggccagatgtgtggatggctggggtgtgggagaggccttgggcactggaggttgtgctgtgctaagggtgagtctcaggtgtcctggccctgaccagaggcctggggattggtcagatggaaggcagaggtggtgtggctggatggggtattggaggccacttgagagataacgaccacccccaacctctaggggccggaagtaagcacggggtgggcaccctacctttcagagttctggacctgaggcaggatggggcatcctcactggtgccccccccatccctccttggggggagtctgccacagtgccgggaggcagtggccacagctgcaacaggcaattggctgcagaaaagctggtttgggaaggggtgcctgttctgggagcgagtggctctccgtggccatcctaggatccactcggccctggctcccctggggcctctctgctctgagggaggaaaggcaacagagggcttctgccagctctgggcaggggcgggcagcagagagctgctgtcatggctacggagtgttgcacggagaggccctgggggcctgctgaggtctgggcgagtccctggtttagcagcactggtaggtattgcactgagcaagaggaagtgcctatcaatcaatcaatcagggaggaaggaaaccaggccagctttttctttttgccctttttcacactccagggattatgggtttcttccaggaccggcccctccggaagggctggtcttaggagaacccaagtggctcctccacttccactgatccctttactccaaacatggcgcaaggggatgggagctgcagcccgccctggagctcacggctgcctgatagccggggctcaccctgaagaagtggcccctcttggcaggagtgagtctgaggggccaggcctgtgcacagaagttcagacctggctcctgggcagcggggtgtgagggcaagggccctgccaaccggctgccatctcccagcagtccgtcctgtcaagcagctgagggccagagctggagggctgcagtggctggttagggacaggacgctctctgggttccagctcctggacacccagtctggacttacttacctcccaggcagacacattgtgtgggggagttggggttacagctgttcagaacaggctcagggcacatcctggaaaaagcccacgctggagtgtgaggtagaatacaggtgaccatggactggggcttctgtagaatggggtcggggtgcctcttttgttttgctttgccatgggtgtgggtgaggtcctcctgcttggcgttgcctagggaggtgcctggtggtgtccctgtggcagcactgggatctgcaacaggatggcctggccaagggctagcggccacagggtgcaccaggcatgcagaggaacagccagcctggcacctgtcctgcccctactggccccagcccacatcagtgtagtgatatggaatgttaggtatggggatacatccttctgatcagacagacacagactagcaatctgtacaaacacaaaagaatccattttcagaaaaataaattactaaggggagaggaagaaagggtccactttgcttttctcaataaatatgcaattctgctcacctaagacttgaaaggtaattatctgggggtgggattctaacatcagggtccacgaaggtgattctaaacagagctgcagccccagcgccttgtcaggggagcccccaacccttccagagctgccccgttggcctcttccaagcaggtcagagcacccgtgtggtgagattccaaaaaaaaaaaaaaaaaaaaaaaaaagtgtccttgtgcccaaagtctcaggtgcttggagtgtggctagaaacagctcttttggatcccacctctttcaaaaacaaaatgtaccaactggtgaggcaggaagccaggtccaggctgggacagcctccttccctagggcagtgcgctccaggtgccggtggggtcagttctgctgtaggatgaggttttccagttcatctgcagagcgcagcaggaaggcagcagactcccggtagcccgcgatgagctgccgcacggcgctgatctccgtggggctgagctgagcggtgggcacgggcctgctggtgctggtgctggagggggtgggcgtgggggtggtggaggtggtagaggccccgcctttcatgctgaggtccgtgggccctgtggagagggaagtagggtgagaagggagcagccaccctgcctggcatctgggaggtgtaccttccttggcactgtcataacctatggcctagtgcccactgtgagttgggcactgaagtccgtggctctggtccatctccctgatggctctatccctagtgcttagaatgggcctgcgggcgacagggttctcagagaatcctcagggtgatcttgcaaggatccggttttaggtgaggaagaggcggccttggggcaaaggaactcctaagatctgcctctcctcagtgtggtgagcagagcttgggaatgggaaatactacttccattgaggaactgtgggacaagtgctaaaagaaagcctctgccagtgtgcctaaaggagcagcacccatctgtgtgctcttccccagcccagacaccgaggctggaaggggagatggtgtgcaggagactctgcaggtaggcaggggcccaacacacctgagagatgcgtgtggggaaagcccaggaggagctgagagtcgagccacaaaaggccaggagaagaaacatctgtgtgcccagacaagaaaggggcttctgtccagctggagagaggccagctgccctggttgtctggggggagaggtacaggccagactggccaggccataactgcacccccaggagggaccatggcagccagtggatggaggaaggggctgggtgtgtgaagcctctttctgctaagcctcaagcacctcgaatcccccctcctgggaggagtcctgtgcctgagtgaggtggagggttcatgctgctaggatacgagggagtgtgggccggaaccatcaggacaagactcagactcgcttctggagaaactgcccgccctttgtcctcggatgatggcaaagagggagcctgccatctttcaaaacacactaggggtgtgcgtgttggggaggggaccgccaggccctgtcctctcttggcctttcccaagaagctcctggctttggagtcaggcaagtgtggattcaagtcctgctctgctacttcattggcaaattctttaacttctctgggcctcagagccctcatctgccaaaactaggcggctcctgcgagcagaagctgagatgccggctgtgaaacactcagcacaggctgaggctccttctcagcccacaggaggcctgactgcctagactggcccaatagggaagggcttccaaagaggtttcagggctttctgaatgggctcccaggagacctggaagctcctggaatttgaaaagcattctacaaggtgttcggcaagaaacagccaaagaagagagaatctgggcaggtgcaggcagagctgccgcttccctgggaagccttctctgatgcagccaggtcagcttctctgttgtctgccctccccctggagtcccttccccacagctttatcttccacgggggtgtgaggctcccccagctaccctgaaagttctgatggtcacattctctcatgattgcatctccatggcagtttttatgctgctatgaagagagatggacaagctcttgtcacgggaggtatccagactggaagtaacatcttgggataaactatggaaacctgactgctgctaaaaggaagctggtgcagcccccaaatggggaaggaagctggagtctaagatgggacagtttgtcacatggggttatttcctctccggccagagaatgtggacaccaaggaggaggtcctaggaactattttctaaatagcgtccttggaattgagagttaaggaaacagttgagtctgttaaaatcaaacacagggggaaggggttggggctgtgtctggaaacagcagccaaacaggtgactgactcccagggtgttgtcacaatgcgggactgagaagcttggaacaggagtgcctctgctaacttctggatattgcaggggatggacccagagggatgcgggggaagagggtctggttctctctagggtggttctggtcccctctgcgtcatgcttgggagtggccagagcctcctggcatagtcaacatgagcagtggtcccggttcctttcttttctcctctccccaagtgctatcctgttcatgcctgtgctcagagcttcctcccttctctcctgggctgtagctgaggcttggaaaggagaaggtccctgtttcctgcagctgatctgatctggagacacccccgtgtagactctggttacagccagatgctcaggttgccgagggactgccgtatggtgggtagagggataggagtgagcatgagttacccagcaccccaggcaagacaggccgagcctgattctatctaagctgatttgcatctccagatgacaacataatgagcaaagtgaggagctctgagccattaatacggctgcccggctgaggtaccaaactgattgaacaatacttgaaaggctgaggctggggaggccagtggggctgggtggccctgcaaccacgtggctgcctgttgtcttccttcaactgctggaggatttaaacaatgttcttcaaatgaggtactagtgctcaaggacaggggctgccccaggcaaggaggtaaatgaccagatttctgcgtcagtggcctccccacccaccatgaaggaaccagggtattcacagatgggagactgagaccccaggatgcacaagggcagagccagctgcctccctggaagaatcattctctggctgctgtttgtgcctcttgggcaggtgtgaacgggcaggcatgaagcaggctcagccctaatatgagaggcccttaggagggtcagggggacttggcagccgcagccctgaaataggtcatgctgggtggacaccaggtagaggcttgtcaccatcgcctgctgctaggagggagcaggccccagaccaccctcacctcacctgctgagccccagacccccatgtgtagggggggcagggcttttcttcctggaatgaaaggagcccgcctaggacagccactccacctctcaccgtgctggccactccggccttagcttcagggattagggccaggcggcctcttattttaggttaagaggcattaggaagggatgaggagttaagcccaggcaggaatcttccagggacctgcatacacttcctggttctggggggtggcgggggtcaaggcgagtggaggcagcctgggcttcctgccatgggtggggactagctccctcccttgctgcccaggaacagtgaggggtctcctgcagccaaggatgggggcttagggaatcctcaggcatgtttagccaagaccttgcaccagggttccccagcttacaggtggcacctttctccaacctactcaggttcctcaattcttcccttcattccctggcttctgaacgacccccaaagcacatggcttctgcctcttgctctgcccattcaaaccttcttacaggggcagacagaatgacacagaccacacaattcacggcccttctgtgcttaaaacctagcaggggctcctcctgcacacagaacacaacccgagtgcctggcccaagaggtcctgtgacccaccaggctgaccccactcctcccctgcttcccttggcctcacagtaaaggggtctgaggttccccattccagttcgtgctcacggcagcacctgactccatgaggaagcctctgtctcttcgggggctgtctcctctaatggtctgtgccccatctgcgcagagtagcctggggagttaccggaaaagcacctactgaatcacccagctacaggagcggagcgagggagcaggtgtgcaccatcaccccaggtgtctcagatgtaggctccatgaatgcaggggcaagaacggaggcccagcacccaggtgaggaaagctttcacctcacaaggcaggccctgagctgaggcctggggagggagccgccctgcaggccagcggggccacagctgggccaggccagcagctgtctcactgagcctcagtcgctatgggtgagacagacggggctgcggagattcaactcaggccaagaacaggcccttggctgggactcggcacccacagggaccctgggggagtggaaccagtgagaggcgccggtagtgaaggtgggaagtgttggagcaagcgtcactggcggtgagaagggggcggtaggtttttgctttaaccaactgagtctccttcaccttccaatctaaggaccagctaagacgatgaagtggaagggtgccagagccgcccctcctgctccctatgctgtgaggcagcccctttccatcactggcctctgcttccctctccccattccgctgcccagggctgctctgcagacccagctgggtgctggtcgggaagccagagcccaggcctcccccgactcaccattactgtggtttcctgtttggagggaggcagggggctgcaggttgctgctcaaggccccgtacccgcggtaactgtagttgaggccgccgttggcgtacacagggtcctgggagtaggaggaggctggcagtgagtaggtggagtgggtgatggctgcggagtcccgcgagtgctgcttgtccagggctatgggctcatcctgcagaggggagaggggggcgctggggaaaccaaggggcagctggccccaactaccatccctggacacaaggtggataaatgctgcggccccaggactcctgggacccaatgctgcggtttgacctgtgggattctgtctgtcccctcccccagccaccttccccccgggggctttccccaactctgctcatctccctgtcagcgtatttgatcagggccctctggtctccagatgaagtccaggcttccgtatgaggtctgaggagctctgagaacaacacacctgacctccacccacctcctctccttgtctttgccctcctgttccccctctgcccttctcccgactgtacccatcacagctccctcagtccacacccatataaggcctgccctccctggctgcccaggagcggcccctgtagtggctgcggtggcaggtacctgtgaggactggtagatctctagacgcatccgcttggctgcctttcttgtctcgctctcacaggcagctgccaggatgttttctgccatggccgaggtcagatggggtggcgtgggtctggtctgcaggcagaacggggatggagctagcatggggcccgtgggggccctgggcttgtgcagagaccctgccccaggggtgggtggcacagggtggggtttgggctccagcgcctcagtctatggagctgtgtgatctttctgggccttagttccctcatttgcaaaccagggattatggtacttgcttccagggctcctgggaagaccctgggtgaaggggcccgggcatcctgggagtgtggcaggaggtcagtagtggcaccgagggaaagtgtgggccaggcaggggggactcaccatctccatgccgttcttcttcatgcgacggcaggacttgaggtacgtgcggatgcgcttgcgggcccgctcctggaactcagggaactgccggctgcaggactcgatgatggcctggatcttctccttgggctgcttggagatgggcaccatgcggtccaggttctcgtccacaaagagacgcacaaacatctgtggagacacgggccatgggaagggctggccctggccttgcccccatcccaccccacctgtttccggccggtgctcacgttgaaggccttaagacgctcagggtccatgccttcagagtcgttcatcttgtcattgtcctcatggtcatcgtggtcatcgtcgtcatcatctgccgtcggggcccggcccactgtcaggtcctcagggcagccgctgacctcggtcttgatggaatcgtagctcccagagctgtaggggggggactaaaaggagggcaagaggcagagggttgggccaagcagctgctcaagcccttgctgggtctcctacaggcggtgagcttggggaccagggtggcacgcatgccctgctgccacgagagccatagctgcgaggccctgagcaagtcactcccctcttctgctcccttcatctgtgcaatggggacagcaatgctaccacctccctccctgggctgccgcagggaggaccgactgcaatagtgtatgcagagacctggttcccggggctgctgagcgcttaggagggtgtcagctgtttcctcagcagaggccaacaccaggacctgccacgtgtacaggggaaaggcagacatggaaaggactcccaccacccgccagcctcctctcgtgccaagatatattttggcttcggggttttcctccctgatccccaaggggctgcaaccccaagttgacaaccgagctgtcaccaaagcaacgagcatgctgtctgtcgggaggaggaacagatgcgctgggcgaggtagccagccagggcgacaggtccgttcagcaggatgcgttcccgcagctcctgagctggacttctcctgtctgccccccacccaggacagcacagtggccccttgagaatatgcgggtagaaagggagagggaaccggatccggcctcccccagcagtctcctgtcctccagtagagaagggctccagccctctgctcccaccacgagtttctccctggccaagcccctcaaccatctctccttaggagcagctccctcttttcccccatgcccctccatcttctcatccttcatggctcagctcccacaccacctgtctcctgcccctgcctcggggcaccgctctgggacggctgaggaccactgttgcctttcggaaagtttgtgccttcgatgtgtcctaagtactcgttcagatcgtgactgacagtagcctggggacactgtccctgccctcaaggaggttggcatctagcaggtaaggcaggctcagggaacaggtggcggtatggtcagaccctgtgatgtggcagcatggccatggcacagcccggaagggaacagcactcactgaggagcaaatccaggaagaagggcattgcctggcacctggtcccacagcacggcccccgccaggcctctctccctgggaccaggcccgcaggggttggtgccctagggtcactggcctggtgcctgtctcttcgtccacatacagacttggataggggcaggatgccgagggcccccgctggctaccataactggccgtgtggccccaggcaagccacattcccacgccactcctcagccaaaccctgagccagggccagggcagacagatggagaaaaaactaagataggagctgctggtggcgttcctgctctcatctcacttccctgggccccccatgtaccctgtggccacagtggcaatggctgctgaacacaactcacccccttcatggaacagcagctatgcctgtcccttggacccaggcaaagcctgctctggccagaacctgctcccagccacctgtgctagacacatagcaacaactcagcactgagcccatggtacagaatgtccccacgagacattccaaatgaggcaggcagtagcacctactccactctctctgcagaagagaaaacaggcccagagagggagaagagcctgtccagaggtgtaagctccaggaaggcacctctggcccccgggcccaggttggagaagaggcactactacaggaaaccttagtggcccggaggcagcttgtggaagtgtgggggaggccccaggaagcaggggggatgcccactggtaggggtacgtactgtgcccacccttaccaccgtccatcagcctagtcaaaggaggagttccactgcccacatccctgggccctcgcccttttttcgcacgacctataaaatggggacaggcacgcagacaaaccaggcagtgggaggcctcgtacctggctgtgccgaaagtggccacttgctgttatccccagcagatgctgttctgggggagggggatgggttgtggggatgcatatccacctaccacctctaccaaggcaggggccgtcagctccacttcacaggctcggagaagggggcctggcttgggggcacactccaagccatctcccattccagagcttcaccaggaaccgaacacataccagccacagccaccaccctggctcggtgtcacacacatgggctggctccagctaagctctgggcgtatacaatttcattctcgcctcgcgacagccctttacagaaagaaatggactcagcccccagccccacacacctcgggggtggtcttcaccccgtatttgacgcggctccgcagcccgtcggcaccgcagccatccgaggggtaggaggctgtgccaagtgccgtggccggcgggagcttgtcacacaggttgatgggctgatcctcggcggccgtggtgaagtccatgggggccacggcgccgttgccattcatctcggggaaggcagggtcgccctgcgtgctgctcgacgtggatgggttcagggtggaggagccattgccgctgccactctcagaggaggagtcatctggaatgagaggcctgggtgtgaggccccacccaaggcactgtggccactgcagccacctcggagtatcccaccctgtgtcctcctcatgagtgtccctgggttggggtgagtgctgctaccccacctcagaggcaatttgccccagcccacagcctcagctgaggcagccacagggtcccctctgccagaacagaggggccatcaggaggggtgtggccaggcagggctgtgcagggcatggagggtcttcctgcaccccaaactcgcaagcgttatgtccaggcttaagggagaccgagctccaagggtttgggagtgagtggcctgtcagagggccctggaggccctcgaagcccggccaggctctcccttctccccagctcccaggaccgcacctcccacccaccctgctcctgctgccgggcactgccttgcagcttcgagctctcagagcccctgcccacggtgggccctcaaatgtctccttcctctgccggaagcaggaaggatggctctactgtgacctccagccattcactccctcctgtaagcaagcccagccctggcagcctaggcacaggcacggtggcccccgaatctgcgctccgtgcaggccccacggcctgggacgtgcaaagccggggctgcaaggtctggggtctgcacgcggcccccgagtgggcctgcccggcgtctcagggtgggcagccccggcaaagcactgcgagggcgccccctgccgcaaagagcgcggcaccgccagcctgcgggcgcgggggaggaaactttaaccaggggaccagacagttccagatacattccaggcctctctgcccacccagccccagccccagccccggcctcctgcttgctcagctgagacggcagaggctgaagctgcacgggaactcccggggtcactgtcaggtgagcacccgcgagggtcccggggaggtacgggtgaccctggcggctccacacctgcacccagagtgggtgggggaggggtggtcacagcgggccctgccgccccttcccccaggccagggtcacgccggaccccacccccaccctcccagccggcagattatgaagatttagtccccggtgctgggcactgggcacgcgcacctccagagcgtccccatggcgaccgagcggctctagcgccccaaccaattgctggcctcccggctgcccgggggcgggtccaggctgcccatcatgcagccaggccgggcagagggggatgggaggccacggcggcgcagtgcacccctccccctcggctgcagcaggtcccctgggccaggcgtcctgtcctccttcgggcagcctagctccaccactccctccatcctcccgcagggcagctccgggctctgctcaaagcccgcccatagctgcccctcactggctgcatcctcggagtcccggcccgcgctggctgtccccgggaccccacagcctactcgcgcccagtctggagccaacacattccccagcatttttactgagcacctactgagtgctggcctggaaacaaagtaatgactgcaaccaaggtgccagacctcctgggggacagatgtgccttactcagcctcgtgggtaacagggaaggtgaattgtgagaatgggggtgcccactttcctccacccgggaaccagaccagctcctcatgcagctcccactggctgctctccagcgcccaggccacccacatcccacctgtgagagccaggcctaatcctcactcccctgtcccatgctttcctgtagctgagtaagagtccggcccacagccactggcactctcagtcctgtgacctctgcagtcccccagcccagcctcactatcctgtgctggagctctgcaatctgcctgccatgacacctccagctgagcagatggcagccagccttcaaggtctggttccacactgccacttcaggctggcacttttctccactgtccctaggaaggaggcactcacgcctccaaccccagcttgctgcccggccctgccagggatcctcatgctcccttcccctggcccagggtcatcgtgagggccatctgccccaccaggacagaccctgtcaccagagaagcccctgcacctgaggtccaggagcctccacgggggacagggatgacacccatactggctggttacccacgctcccatgagctgcagggggcccatccttcacccaccttgcaggtgcgacttcacataccgacaccaccctcacaggccacttgcttgaccttggagggccttagattcctcctctggaatgaggggctgctcctcagtgggcatcgtgcctggcacacagtgagcaagtggtcactgccttcatcacaggcaccaggcccaaggctggctgcagtgccacaccctacataggcccagaagtgacatcccatcatcccaccacccacctcccaatcaggttttcccgagaagatggacttgccctccgccactgtgagctccagagacacgctgctcagggtgctcctggagcctctaccaggtcagatgcccggcacgggggcccagactctccagctaccaagacctttgcctcggggctgtgcccccggctgcctggctggggatcgacaggcactagtgccggggcagaacctcccctaactgcactcagatgccaccctggtctggccagggaagtggttgggcgggtaagacccgtaaggcaccaggtgctaggacctcgtatggccaagtgttccaagctgttagaagaaactggaaatctgcaccattatgtaaacagattttaaaatattggcgactcagttacatggtttactttttttttttttttttagggtcttgctctgttgcccaggctagagtacagcggtgccattagggctcactgcaactgctgcctcctgggctgaagcgatctccccagcagcgcacaccacgacgcttggctaattttttttttttttttttttgagatggagtttcactcttcctgcccaggctggagtgcaatggggcgatcttggcttactgcaacctccacctcccaggttcaagcgattctcctgcctcagcctcccaagttgctgggattacaggcgcccgccaccatattcagctaattttgtgtatttttagtggagacacggtttcactatgttggccaggctggtctcgaattcatgacctcaggcgatccgcccgcctcagcctcccaaagtgctgggattacaggcatgggccaccgtgcccagcctcggctaatttttaaagttttctttttttgtagagaacaggtctcgctatattgcccaggctggtctcaaactcccaaggctcaaaccatcctcccactttggcctctcaaagtgctgggatgacagacgtgagccactgcgcccaacccattatttatatttttaaaaacttcgacaagtaaatgggtacacaaatgtggtctattcatacgatggaatagtatccagccatgaaaatgaatgaagtttggataagcgctgcaatgtggatgataaaaacacgaggctgtgggaaacaggccagacggacaaggatactcagtgattccacttctacgcagcatctggaacaggcaaattcacagagacagaaggtacagtgaggctccacgggctgggaatgggcagttagtacttaaagggtgcagagtttctgttgggggatgaacaagctgtggaaataacagtgcttctggagtgtacacttaaaaatggcaaattttatgtcacacattttaccacacacacagaacccagaccaaaaacagcccctttgccctagtttataggctctatctgccattatctcattttctcatgccgcacacacagagcctactcagagggacaacatggatcgcgaaagcctgccttccccagtgacaccaaggtctcgcctacccccagctccgctcaggcagccccggcatgccagcccccaccccacacagctgcccccgcgccacatgctctgggggctgcctgcaacctgaggcccatgttttgccgactggggaggccacaggtttgagccgcggagtggctggaagaggctactccaccttctggagcctccgtttcctttcagagtgggtcccacagccgtaaaacacggttctaaggtgaggatggtgcccgagatggggcaggagctcaaaaggaaaccccaattccctgcaccccacattttctcacatcataactcacccactgccgacgcacgaggctcccagactgcaacgggggcttctggggatcccggagcccagcctgtgacagtctgaggtgggcccagtgagagggccactgtggggatgggggcaactgccaccctcggagctcatgctccagcagcgacaaatcaaacctgagggctccagaggagacggggctctgaaggggtgtcaccagctttctggcccctgagccatggtgtctcccctactctcggcgactcctgctcgcccttctgtgctaacccgagcaccaccacctcagggaagccctccctacctgccccgatctccatcgtggcaccggctgtgggccacggctctgcagaagccatcccagggacggtggggcgagggctgaagcctcatgaaccaacaggggcagaggtgctgctcggggtggggttggtccagcctgtccctcggccccacaagcagtggatttgatgccggctgcagccgcaagggctgagtttactccaactggaagccaggtccctcctttgggcccaccaggcccttccagcgagcccctatggctcacccacccgccccagctgtgacccagccttggtacttgctgttccctcttcctgctccactctgtcccgggtgtccccttggcgcagtccctcacttccagggctctgcgtaaaggtcaccttctcggtaagcccagctcccaccctgctctggcacactgacccctctacctttcttttctttttttttttttttttttgagacggagtcttgctctgttgctcaggatggagtacggtggcgtgatctcggctcactgcaagctccgcctcccgggttcatgccattctcctgcctcggcttcccgagtagctgggactacaggcgcccaccaccacgcctggctaattttttatgtttttagtagacatggggtttcaccgtgttagccaggatggtctcgatctcctgacctcgtgatccacccacctcagcctcccaaagtgctgggattataggtgtgagccactgcgcccagccccctctaacacagtagtattgcaaggagaggataagtgcttggaagaaattacctatttcttccaagcacttatcctctccttgcaatactactgtgtttattgtgtctctggcctgtgcccagccttcacagaagcggccccagccctagagacccagagttggtgcagctgtattgggtgggcctggatggctcctgctgccccctagatcacacccctccctctggtgggggcaactgagtcttcctgggctcgccggggtgagtgcatgccccaggcctggccagtcaacccatcacagcaactggtaatagcgtgtgaccaagctgggcccgaggacatcacgcggggactcctgctgcgatggctgggaaggtgctctctacctggggttgctgggcccgtggtgcagggaggcccacgctggggaaagcagggctgatagggggcacagatgatcccctgaaatccatctgtgcctgccacctaggaaggccctagaggttttggtgagggagctaataatttccttattggttaggccggctagaggcaggctcacaccaatggcttggtctctgagtagtccagggtcttctccctggcagaggccaagggatgggacccgggggctgggatcgctctgcatggggacctcaccatgacgcccagctcagtcctgaggaggctggtacccacaggagggggtggtgcccacaggagggctcatgcccacagaaggggctggctgcaaccctcacacccacccctcactgcacctggccaggagaacgcgcctgtcactgtttggggaaagaaggaaaagagagactgggggcagttgggttttgatccgattggaattcttcctcccacaacccttaaaaaaaaaatggatttaggccaggcgcagtggctcacgcctgtaatcccagcactttgggaggtagaggcaggcagatcatgaggtcaagagatcgagatcatcctggccaacatggtgaaaccccatcactactaaacatacaaaaattagctgggcgtggtggtgcacgcctgtagtcccagctactcaggaggctgaggcaggagaatcgcttgaacccgggaggtggaggttgcagtgagacaagatcgcgccattggacttcagcctggcgacaaagcgagactctgtcttaaaaaaaaaaaaaaaaaaaactgatttaaaagagacatcgacaggcgcacaaacccttgctgtgatggaatgcagtggggcccgggcagggatggtgctggtgtagggtcctgcagtctgggcgaccttgggcactgccacctcctgggcctcctcttatctacagtcctgggagttgccgctgacgccctcctgggctctggcactttatgactctgtgaagaaacccagctggctccatgggcaccgaagccccagcacacaggcctcacggggtgcaggcctccagctgggaggctcagtgggaagctgggagttctggatggaccctccacacctggagctggaagtggaacctaagggtgcccaggtgacctcttgtccccacctggtccccatcttgctgcttccatgaggcccctccaggagggtcacccttgaggccaacctgctggggcccagtgtgatgaaagcagggtgggcctgcccccagcccatggctgcgtgggcagcagagacatgtcctgaggggccttggggaagcagcccgggatgcaccccctctcagcatttccacaaaaccaggccctccccactgtggcaaagggcgactccttcatctgggcaggacccggagcccaccacctgtgcccagaatgcctacgggcagggaaggactgccgtgtccgtctatttgaacatggggcaatgtgctgctattcaaatggaggaattagtgatgaatgggggaaattgttcctccctctgtcccgtctccagaaggagacaaaaaccccttttacctcagcaaacaatgcccttatgtgggcgccagtgccccgcagcccgcacaagcccagctctgtgcgaaccaccaatcgccacaccgcgctctggggcccacagccagtggcaccctctcccggtgggcgactcccaccagctcccaggctaggctcggagaacgggaaggcccaccatccctgggaccacaggccaggtacacggccactggaggccagcaggccctgcgtgcagactgccttccgtgtccagaggtgtggctgctggaggcagtgccgcctccatgagactctgtcacagcagcagccaggcgggggatgggaggggcatcaataattcacacacaacagggcgacgggggaggagggggtgggagactgctggagccacggcccaccatggccagggaggcgtggacagtagggctatgggctgtggtctgggggtgctgaccctgctctgaatttgaggcgtgcacctccccaggactggccccctgcctgctttgacaaaggccagcgcccaggctgtgtttacacgatgcgtagttccaaggagcaccaggctcagggcaggctgcccagctcttcctccagaaaggcaggaggggtgcaggggtcaaatgggggacactaggaccctaccatccgggtgatggggccacacggggcacctgcattctccacgtggccctcaggccccagctgcctgcacagctgccctcctgagcgcccagctctgtccctgtggttcacacagcctggcccggccccagccacggagcagggagcccatgccccccatctgggtgccacacttgccccctgatttgcagccccggggcgccagttcctctacccccacagcatgcgcctcctctgcgtgtgcccctcagtgcccgggcagtgggcgttcctgctgaaactctggtcactctttgcttaggcaggtgccaatttaggccctcacagtcgggagcagcactgtccgacagaaacagagtgggagccgcatgagggatttgagtgccctagtacccacattttaaaaagtaataaagaaacaggtgaaatcaattttaataatctactttatttaacccaatatatccaaaatagtaccatttcaacaaataattgataccgtgttatcagagctgagatatttcaccttcttctttcctacggagccgctgagacgcagcgtgtattgcacacctgtctgcactagccttttccaaggctcagtagccgtccttggctaatgaattagacgtcacacacctagatcttcccctaaaactgaaatcatttctctctgcagagaccctggggttcctggcccgtagagaggtgtccaagctgcagatgatgttcaggccttgggacaggtggctcaagcggtggggccctggagacagacaccaccttcagtggagggggaggtggacaccaattatgcgtcaggtcccgagtgtcaggcggcgggtaactcatcatgcctgatttgcacaaccaccctctgcagcagacatcagggaggaaccagaggctccagggggaagtcaccgacccatcacccgggatgagtggaggcgcccagacaggccccaaagcaccacccaggccgcccagtgctctcagacattctgggagcctccaaggccagccttgatttgcccatctgtactgtgggacaattccctacccctgctaccagactgctccacttcctagagcccctcccccaacacctactggccactgatgccccggggaagcgctcccaggatgaactgcctgtgtgtgggtgttctccctggccccgtcctccaggccaagcacaggcggtgagaaataaacactaattcagtgtgcaaagatcgagccgagacacacagcctgctccccgtgttctcagagcaaacagagccactccaggccaccatgtgtgaatgattcacggggcagggccctggccccaaagcccctgcaggccctcctccagccctcccggaagccagtctgggttcggtgcattgcagtccttaggtcggagtgatgacgccaacgcggcctggtcacttcctggttcctgggaaagtcacccttgaacaggctcccggtggaggtgcctcaggagggcctgtccctgacacaggagcctgcaggatggagctctgtatgtgtcctgggctgaggggtggtggcgaagggcaagggcactgatccccacgtggccccactgggccaggctcaccttcacctccattctttttttttttttttttttgagatggagtcactctgtagcccagtggtgtgatcttggctcactgcaacctccacctcctgggttcaagcgattctcctgccttagcttcctgagtagctgggattacaggtgcccatcaccacgcccagctaatttttgtatttttagtagaagtggggttttgccatgttggccaggctggtctcaaactcctgacctcaagtgatctgcctgccttagcctcccaaagtgctgggattatgggcatgagccaccacgcctggttcacccactttctcagtaggtgaacctctcggctcctcaggccccagagcttgtcctccccagcatcccagacaaggccagggctgtgtaggccctgcccactcctggataaagggatctctcggtgctgtctcccagcgtctctcaccccttggcgggccggggcccagcacagcccagcattgtctgtgccgcctgcggcccagctgatgatggacactttcctgtgacccgggactgccagtgtggcccacagccaatccctggaaggcttgggccccagctctctgctcctgggggaggggaggccaggaggccgccgcctgctcatctgttgtgggtatttggagccttgaggaggaacaaacagctcttgctcctggggtgggggtgggtgggacctgcacccagagaatggggcccagctctggtttctggcctcagctgtgagaattagggtcagggcaatggacacagccataatgagcaggtgttggggagaaggcttggcttaaaagcccactgcaagagaagcctttcacaggccagcccagggaggctggtgcaggggccacacctcctgccatgcaatactgaccagagcagacgtctggccatgagtgttgggtccacggggaggcagcagcaggccggagttctgtgcctcctggtgggagagggctgctgtgacccagggatgggcccaggggagggtgggcatcacctgaggaggacactagaaagagccgcggcacaggggtaatgcgggtaatggtctctgagcccgggtggcctggtcgttactcccaccagctccttccccatcagccttatggcttcctgcctgatccctcacttgaacggcttcacgctgtgctggggacaccccatggcaccctgagtaccagaagccagaagcacacttctgcctggcaccttctccttggatggcagcactgactcctcgctgcctgcttagctgcccatcagtgtgggcacctggatgggtctggcatttgccagattgagaagcagggtcttgggaacttggggtccctggacagggcctggcacatgtgggtggggagggagggacagggactcaggacaagctgtgagtgcctgggtctggttgacaccaaggaccccctagcccggctccctttacgaagaagcacaacccgggcggtggttgggagctgagagcaggggtggggatgccgctgagggtggctgtgaggtaagctgcagtcagggtcccacaggcctccatggcagaggggaccaagggagaccaggctggctgaggaggcaagactggaccaacggggtggtgcgcagggctcagagaatctgggggaggtgaggaagaccgcccacatccagtcccagcctggcccccaatgggcctgtgctgtccacatctggtcctcaaccgcctggcaaggtgggccaagatgatcacccccagcccagcaaggggttggcacccgcccaaggctgcctggcaaggagggaactgagcaagatctgagctctgtgtgcccccacacttccctgcagacctcttggaggccagggaggaggcacacaggggagggggccgggccaaggagaagaggccaacagcactgctgctgtaaataccgagccctgggcactcaggaaacacacctgctccccagagacccgccctgctgcccagtttgcatttctgggtggtggagggccccacccaagggcagcaggggccaggaggtaggaagccttggtcttctcactaagagctcctgggggcatgccaggatgaggggccacagcccccaggccatgtcacagagagaagctgtggcccagagttgggggatcggctagctcaagaccatacttcggggaagggccggccagatccatggcacagcacccaggacctgcctacaggatgccacatattgggcccgaccactccatcctcccagaacccttccatgccagaccctccccagatggcctggctgtggcctctctgcccttctctcctggttggagcttggggtcatagggagcttttggaaacaggtgacccaagaaaccctcaatcctggcatcgggcacctcctcccttcccagccccctgctgccacgcctctgcccagcttcccaggccacctcctcccaggccctttctctgattccccatctctgccaagagtgactcagtggccgttggttgagcacctattcagtgctagggcctggggataaagcccaggacaggagactcaggccacatggggccagccctgaggggcaccctgcagcgccacttccagcaatgaaaaacagggacttggccaagcacggtggctcacgcctgtaatccctgcattttgggaggccgaggcgggcagatcatgaggtcaggagtttcagaccagcctgaccaacatggtgaaacactgtctctactaaaaatacaaaaattagccaggcgtggtggtgcacgcctgtaatcccagctactcgggaggctgaggcaggacaattgcttgaacctggaaggcggaggttgcagtgagccgagattacaccattttgcactccagcctgggcaacagagcgggactccatctcaaaaaaaaaaaaaaaaaaaagaaagaaagaaagaaagaaaaacagggacttgagtgtccttccacaggagtggccaaaacgctggctctggagagacccagtccctgtggtctgggcaagttacttcccctcggagacgatgtttcctgccctgtggaacagcgacatgtatagctctgggctcacagggtcaggctgggcacacagcagggtcaggctgggcacacagcgggctcaggaatgggaccccagtcactggactgactagacaagctttgaactgtggctggcccacatcagtgtcagggaggccaatgactatgtgagaaaaaaggcgccaatactgcctcattgaaaagaaaatgaggctctggttacttagatacatagaaaagtctgagaaaaatagggccccagacatcattatttttcattttcttttttcctcctttatttttctatttttttttcttttttttcttttttttagatggagttttgctcttgttactcaggctggagtgcaaatggtgtggtctcggcttactgtaacctccgcctcccgggttcaagcaattctcctgcctcagcctccggagtagctgggattacaggcatgtgccaccacacccagctaattttgtatttttagtagagacagggtttttctatgttggtcaggctggtctcaaactcctgacctcaggtgatccacccgcctcagcctcccaaaatgctgggcttacaggcgtgagccaccgcacctggccttctcctttatttttctacaataattgtaatacttctgaaataaggggagaaataagggacatttctacaaagatgtggctcctgccctcagcaagctgacagcctgcaggggtcccacactggtgcctgtttggcttcaaccaaaccccagactcctccagggaggtggggacagggctcatcacccctgtgtgtcacaaggccaacgctggtgtgactaaagtggccaagaacctggaagagccaaagggccctcagtgcctttgtccagactcaggcctgcacagtgcgggagcccgtgtgtcccgaggcccaggttggaggagcggcctcatctgagaggcgcacacaccaggccctgacctgccccagccagggctccacacgactcttgctcagcaatcccccgactgcccaccctgcagaaggcggatgcaggcccagcgagcagacccctgctctcccctggcgctggcttcctgtctgcccaggaggtgagtaatgtccgctccctgcccccacgcatcccttctggaggccagacgggcctcacattttccgctcaggaaggggcagagtgagaggcctgctgaagcacatccaggggaaacggaaggagtggccccgcctgccgggtcaggaacctgggccagccccggcctgcaggaggcgcactggctcacctgcctccgtgcatgccttcgttcattttcatccactcattcattcaacaaacagcaccccagcacctgcgtggtgccaggccctgtgctgggtgctggaggcctggctctcagggtgcttatggtacttggggaggagactgcatcaaacagatcatcccacaggtggcggcgtaagtacagacggatgtgctgttcagccccaaggcaacgccagaccacagtgcctctggacaaagtctctcaggcatcctccctccacaccctatgatgtgcacagagccctgttcagacccaaaagaaagcccacgcctcagccggggcttggccgagggtctttaggggacctggcccgtgcctgggcaggaaactgtggcaggagctggcccgcatggccctgggccccaaggagggagcgccccaagtgtgtggagagggccttctttggttccctagctgccctgcccatcttctggggaccctcacacatggcccctgcccctgccaaaggggagagaggagaagcactggcacctccccaactctggctgagttgccccaagtctctccctgatcctaagtttcctccccatgagatgagggcactgtgagtggtgctccctgccaagcaccagtggctgtgatcgcagggacctgggagcatcccaggacttcagagtgtggggaactggtgtaaagaggtctgggagaccaagactcgcagccagtggcagggttgggggcagaagcctaactgtgtttcaggacaagcagacactcaccccggtagaacctcagaggcaagctcccggggagtgaaagctgtggcacccgcacaactcactcttgggctcagtttcaggacaagcagacactcaccccggtagaggctcagaggcatgctcccggggagtgagagtggacactcaccccggtagaggctcagaggcatgctcctggggagtgagagcagacactcatcccggtagaggctcagaggcaagctcccggggagtgagagcagacactcaccccggtagaagctcagaggcaagctcccggggagtgagagctggcacccgcacaactcactcttgggcccagtggtctccgccatgggatttgctctgccactcagccttcatctgcctttgttaaaatctttaaagaagggccccaacaaatccacagctgtagatctgtgctaactgcctggctccctgaaatcactcctggctggatcacttgtcagcagggatggggtgctgatatggttgggatctgggtcccctccaaatctcatggtgaaatgtgtcctccagggttggaggtgggcctggtgggaggtgtctgggtcatgaggggcagattccttatgagtggctgggtgctgtatggagtgagttctcactatgagttcatgcgagagctggttatttaaaagagcctggtacctcctccctctctcttgctccctctctcaccatgagacatgcctgctcccccttcaccttctgccatgtctgtaagcttcctgaggcctcaccagaagccaagcagatgctagtgccatgcctgtacagcctgtggaactgtgaaccaaataaacctcttttctttataaattacccagcctcaggtattcctttatagcaacaccaaacggaccaacacaggtgtgtcatcagcacagccttgggagtccccacactcccggcgaaaagaaaaggcccaggtactcagatgggaaggatgtccccagaaacaaacaacccaacttatcccccatcagaggcggagctccatctgctctgcaatggtgtgcttgggtaggtctcagtaaatgtttgttcgtttgttcattcggggataacagacattcagcaggtaccgacaatgggccatgttcgcaaccgagtcccaggggcagggcagagaccaagactgaccttacagcaggcctcagacttccacgaaggacggaaggccagagcccacacaccaagcccacctgggcatcagtggggttggggggcttctgcaatggagaccctcgggcggggagtggagcacacagagggctaaagcgggtgcctctgcttgggctgtccctgcctagtcctgcgtcaataacaggggcctgagagtgctctgatgggagccccttgactcactcatgggagctggacctcacatttctgcaccgtgagcaccttcaagaggggctggttgtatgtctccaggggggccagaagatggcccaggactctaggctggaaacccactgctctggacagacaccaacaggcccacaggcccagaagaggcagcagaggccaggccagctgcctgggccttcccaaggcctgtgccctgcccagggtctcagccagccagcggggtggcccacaactccatgagtgtctcggaggggacagtgaggcccacggccctgtggtcaacagcatcctccctgtcccagctctggtgtccatcaggaggggaaggtggtgtctgactaccccaggctgaccccgcactgggctcttggggacctacagaccccccagcctccctgcatctctcagcctcatcctcatggccaggccagccagcctctgggcagcaggtgctgagggaaccccatggaccccacagaaatgccactgtcagctacctgatcctgacagcccccaaatcaccagacctccccaggacgtgtctccaagagagatcacgctctcaaagggtggtcatgaggaataacagcatgagatctgcttgggaatgagtagggggaccatggtcccttcagccccactgctctgggtttctgaacaactgtcccagacccttcttgtgggggaccacagcctgtggccccagctgggctctgcaggcaccgccctcagtgttccttgggcgtggcctcaatcggctcagttgaggcgggaggtcagctgctgcgcttgtcccagccccagagccccccagagcacgtggctgcccccgccggtccccacccccgtgggaacgctggaaggcggcactggcctgggaggctggcagcacgagggggtcgcaccgacctcacgaggcatcaagcacaaaagccttttctttgccggcagccacgcaccccactcctcctgcagccactccctgtgctccccagcccctggcccagacacctccagctgcctccagactgggtctcctcccaaacaaagccggattcaggccttcgggaggcaggcgcgcaggttctgccatggagatgaactttgacccaaacagcaaggctcctaccccttatttactctttaaggctgacccgtttcacagagttcacattacacccctttttaatccgcacctccctcccacattccaggcctcgaccttcaacccctcctaattgctggctccggctcctacaccccagttcttgggcccagctcactcatccctgcccccaaccatctcctccacggaaacaaaggcgatgctggggtgctgtgctcacagggccacctcacaaccctggcacaccaaggtagatgccagggtcccagagcccaaccacttgggggagtccacgtggaggccggggtggatctttggggtctgattcctgaccctaactctccaacccctgagaaggaagcctctattccaagggaggctggagtaggctgcctggcaggccctgcgcggaggcggtcagggctagggaagaatccggacagctccccagccagccgcatcgcatcccaaggggctagggtgaatgtgggcagctgcactgcctggtcactcaccaggtgacctgggctatagcctcacatgtggctgcagaaacacagcttgtttcccttgctgggcagcggaactgctctgggttaggtacactgtgaaccttcccaggcctgcccctggtaactctgaaacccacattgcagaagcccatggcatcccggcaaccaggcagaccccccgccccgcaggctgccagtcctatgggctctctccctcatctttgggaggaaggagccaggagctggggcactggggcccatggagatgctgagaacactgggggcagtgcaagcttgggcctgagccacccaaaggccttggcccagattccgccaccctggagtgtgtccacacctctcacctgaggacaactgggagcagggggccgggcacagcccctcctcaactgccaccaaggggcactcaccgtcctcttgactgtggaggttctgcgggctccgcatcctctcgtcctggctggggctcaggctggaggccaggtgcgggtcagctgacatccatgtggagtcgctcatatcaaaatcctcgctgctcacagaagtctcatcctgagcagggacaaagaaggtgggcattcagcagggacgggctctcatcagcctgaggcagccttgtgggtggaccccagggccagtgggcgtttgggagtgccctgaaggcggcaggagccctcaaaccttgaagtgagggctgggtggtgctcccccttgcccggtggaagtggccccggctctggttcctgtcggaagccaaggctaagggccggcactgtctgtaattgaagacaattatgaggtctcgcatcctgcaggggcggatggcagggcctggctcttacccttgtgagccaaggttgaaacaagcgctgtaaacaagggctgccgctccctgctctcagcccagggaccggggctcactctgcacaggacccggcggcaagaagcgggcagcagcacatgcccgccaccaggcactgaggctgagctgagtgcccccagcaggcctggcgccctgactcccatgaagcatgcatggaattcctttctcccactcccccagcccagaggacgtttctgtcttcctccttcctaacctttgctgtgcttcaaagatacgctcttgggcagcttccagggctgaaagggccagccccagaagtgcagagaaggaagggggcggggcaggccagggttcggaccagaccgcaaagggggttcagctcaagggcctggggggccgccagggcgttccaaacagccggatggcctgctagagaggaccacgcctgcctcctctctcctcgctgccggcttcgggccggcccttggccagtcatccgggaacccccggggcggggccccttcaacccagccctccagggggaagggcccccacctcctccaggcccagcctttcaggagcagcaagcaactgtgcctgggagctggctgtaaaaccaagaaagatgacccagcagctcccacacccggagttctggcctccccccagcaagacacaatggcctctgtgggcccccagtgaggacctctgacagagcaccccccaagcctcccctccggggcccccctcacagacacctcttttatagtgagcaaacacactttggttggaactttcttagactgctgtccctgaggcagacacatctgctccaagtgctagggaaccagtgtggattcgcctccactccctcccccaccggctgggctggtagggagtttcctggaatttatagcttctgtgcagtgtggaccctctgctgaatccagaggacaggagctgggctgtgacgcctgtagtccccacgcggcacacccagggcctcgggggatggacagagcccacgtgtcctctagtgtcctctccccacacacaggcacacgcactcactctgcctccctcccacaggctgcctgctccataaacacaagcacctccacccacagccctccttcgtgaaaactcgctcacacacccggagggacacacacacacacacacacacacacacacacacacacgttcaaaaggctctgcacaaagggtacaaagggacaacaaaactctcccctgtgctaactggatggagggagacgaaggggagggggaagagaggctggcaggtgggggaaggttccttggagccttgagcaaggctgcaaggtgcagccggctccccatcttcccagctggtcgtgccatgcgggctccgggaaccaggaacggggcatcttgcatgggccccttgctacttcctggatgcccagggggtgccatgctctgggtttgacctgaagtcacagctgaaggaggaagactcttgggtattgttcaaatgctcacgacttaaaagacagagtattctagtaacagttgaaagtgccacctactccaaactccccatccatccattcgacaggtatttactgagcacctgctatgggccaagctccgctctaggtgctgggaaactcagctgtggaccagacacactcctggcctgcctggcacccctcgatccacgagggagatggacaatgagcagaaaaacattgatgacggctgcaaagcacatggaagcagggcaagagggcagagggacctgtttgccagggcagcccagaaaaaccccacgggtcagaaatgctggagcagaggcctgcgagaagtgaggaggggagcccatgaggtctgtgtggctccacgcaagtttcaggcacaggcagcagcaagtggggcacaagctgctgggtttgaggagaggcaaggaggctgctgtgggcaggcatgggcgggcacacggggacagaggagccacacgaaaagttcccctcccacagtgcacgtaaccctggcagggccgtacctgccatctctaggttggagaaaggctcttgaactccactcaatacgcacactctggcctctctcagccaagttcaaaccataacaacagaaggcaaagcttctcaggggcccagcgctcccctggacttgtggtatttcaccctcactacaggtccaccaggtaggtacagttgacagccccgctccacagatgaggaaactgaggctccaggaggttaaggtgctcgcccaaggtcacgagctaacacgaggcagagccagatctgtgcaatcgccaaggactggacacgccctcctaactgagttggccctcgcctagaacccacactgctgctgtgaaccacaatcccaattccaagctgtatccagctgtcactgtcttgtgggtctctgccctgtctttccctggaaaaccttcggtccttccaacagtggggaccagactgtatgtcctctgaatcccgcacaaggcagtgagacttgttgaatcaactgaattgcctggcatagtgttggtgtttaatgaggacgctccattaatttgacaattaaggactctggtcccattgcgcacagttcttgaatggagggcatatgaagcccaggatgcaggctggtgggctggtggcaccctggtgccctgcaatgcctccctcctgccgctgccagccaccccacacacagccagggtttctctggctcacatcactgaactgttcacccaaatgccccctccaaccctcactcccttgatgggtcccactgggaaaaggtgggctacacctaacctggcatcaaaatcacctgattaggaggagcacccagtgcccacaggcacgggacttcaggctaatggttttattagatttcctcccatgaccccataacacaggcacccacgtcaggcctagctccagctctgataactgcccctgcgaggcccgccccgcctgccccaactgcccaggggcacgaagccagcagcacagctggtgtgtagacccaggcagcctgtgcccagagcctgcatcacactgtcaccgcaccatgggccacctcaccacatctcctcccttcaatgggaggaaccagattccttaacaaccaagtgtctcaagatgaggcccagagggaactcatgggtgatgaggctatatttacacacacacacacacacacacacacacacactctctctctctctctctcatgcatgctcactttcttcaatgagttgttgcacatttattgagcatctactatgtgctggcactgtgctagggacatagataactaaggcagggctcctttacaccaggccttgttagctaggaaaagggaccagcaaaacttctgacccacctgtaggtgcagtggggagacactgtggacacactgcctagtcacctaacgatgactgctttctccccagctccccaggaagttttcccacagcctccagggttctgccatgtggaccccagttttgtgaaaagtggttctaagattctgatatcttgactgctatagcttttttgaaagacaggatcttactgtcacataggctggagtacagtggtgcaatagtggctaactacagcctcgaccccccaggctcctgcctcagcctcccgaggagctggcactacaggcatataccaccacgcctggctaacttttaattttttgtagagacaagggctcactatatcgcccaggctggcctcgaactcctgggctcaagtgccttggcctcccaaagtgctgggagtgcgggtgtgagctgccacacctggctgcgacagcaaattttttttaagtgagaaatcaagtctattaagcctaacttttcaaaaacacacaatacaaaaataagttttggtcagacttacacaaacccttcaacacccagactttcaagggctgaggtagagaagaagacttcccaagacccctctgcaacctgtctggcgcagcacagcccagttcatgggtgtaagcccccctagccgcagatgggcagactgtagctccagtccctcactcacaccctaagccaaggctggagaagcaggctaatcacacaggcagttacaagtacacacagatcagaacccgtcaacgacaactgtgcagagggggaaaatacacccaagtccagagggccatgctggaggcactggtgcaggtttgagagtggccaaggcctcaggcctgctcagagacccaaggtgctcactggctcacccagaggtcacagggcgctttttacttttcccttcaggaatctcagatgaattgagggctattttctccctttctgttaacaaacttcaacaaaacttacattagagaataaaagtgtgggctgggtgtgatggctcacacctgtaatgccaacattttgggaggctgaggtgaatgaattgcttaaggccaggagttcaagacccacctgggcaacacagtgagacgctgtctctatttacaaaaaaaaagtgtgtgcaatccattacttctgggttccctctccccagtccccatgtgactggccagtcagctaccccctggtttctctagcctctgccctttggacaccctgaagcccgtggccttgcccacccagcaatcatttattccagcaccaaagccatcatgggtcacagggtaacagagccaaagccaaatgctcttctgaaaagggaacttaagagttaggcaggcagatgggtagcacccagtcagcctctgggacacaccccaacctgggagccctgcctctggggcagagggagaggagctgaccagactctccctgctcttatcttcagtccaaaattcatggacaggttcagtctctctccacccagcttctgaggcccttcctcttctgcatggtaactagcacaaccactgcccagcccaggaggaggagaaaacgggagaccagaggggaaatggtggaaatgggcctgtatccatggcttgtaactacgggcaggtgctatcagtaacctgattattttacaactggggtcaatttctctggaactgggttcctggtgcctctgaagttgagccatttgcatcctccaggacttgggatcctggggcgtgcctcacacggtattttccagacccttcctgagagctgtaattctatctctacagcttgcttgagaaagaaaaggaggaggatttgctgagaatttagtgcaattttaagccataagccctgaccaggagccctgggtgtgtgtttcagaggagggcaggggcagggatgtgcaggggatgtttctgggccaagcaggaaagagacccctctctatacagcccccaggcttgttcgacaggaggctaaagctcccactgggaagaacaccagcctcagggggttgccccagcaccagctctatcccaaagcggagtctcttctcaacccactggtgggcccctccttctggacacctgtaggccccttccaggccctggacattcttccacacgaggcgactctcccccttgtctccatgtcagcgagcattacacacgcagccttctgagcatgccaagaaggtactgaaccgcatgtgaccccaacttaaccacttcagttcatcagatggcttattaatggaagacgaaaaacccccagcatctaaagcaacaggggttcaaatccttgttgtgaaggagccgcacacatgaaacaggagggtggtctgagccacagctcctggggggtgtggggtcccaaggctgttgcttcatggctacaccccaagcccacctagccaccagggaaggaggccagccttccagcactccctgcacaattccactccttcctgcaaacatgcctcctctgcttactagccatgcaagcaccagctcttctgggaaatatgaggcaggaagggctgagacacagccaatcacctaccacactggaggcattctcgctctctctccctcacactcactcacacgcacactgtgtctgtcagaagcgtattcccatctacatgtggtcctctgttgtccctgctgtcatagacacctggatgctggaagtgagcatttcccacaccttcccactgtatatcaagtggaaaacaggcttttgttcctaagcaaaggcacctggctgctccccatcagcattcctcaccacgagggcctcgctggtaccctcagaccctgccattaatgggggtttctttaaaagtgaagctggagagaggagcttcagcagacagggatcttccagccaaaaggaaggctggaagggagccgctgtgagctaatcccctgcagggctgtccttccaagaaaggaacccagacaacacagaaaaagttcttgagcaattcccaggcggtccagctccacagagccccagggtaggggccgcaggaaaagttccccaaaggcgtcttctcagctgggaggaaggccgtcttctcagctgggaggaaggccgcagtgagctctgttcccactgtgcggcaggaaggtgctgaatagggtggtgtcgcccagctcaagaggtgctgtcttaaaaccctgctctataaagcaagcccagcctgagcctggattagacaggagcttgatattattcaaggacacatttaggccctaatggctttccaatgaaggggtaatttactacccggggggctaaactaccacagggcctgggccataaacgggccttttccccagaccaactcagtccagaatccggcctgtgtcaggggtcaagacaggggcctggtcccatcacacagatggctctccccagaagagccatgaggtcccccaaacacctctccccacaccccctttggtgtgtgtgagttggtggggcggggcgggggggggggagcaggctggggttgccagctgattctgggataagtagggctttatctcaagggagaatctatttcaagccacaatccttctcagaaagaggaggaaatcacagagtccaaacaccatttcaggtgaaatcaggaggttattcatctcccctcagagcagacagaaaggaaaatcaatgttttagagggggaaaaaaggttccatttgaattaatgggtttgtggcttctccattgatctgagcctcttcacactttctttttgtgcttttgtgctcttggggagaggggagggagtagggaatggggaggagggggtgggcctcccataaggaaaaggacggtctaaccttaacctttctacaggaataatgctaattagcgaggcttaatgagaacttcccccaggaagcgcagcccggtaggggcggccggactcgggcaaacgcagctccgggtgggagcagggtcacttctgctcccgagcggctggaataaaaatgcggattgcactcccccctcctccctatccaaagtgtccagccttgaagacaaggtggagggaggagagagagggcggaggtgtaaatccaacttaacccctgcgcgcgccctcgaggcggccggctgcccccgccccgccgtgtcccctcattaaggaaggccccttcgccaggggccgccaacgcccgcggcttccggtcagacggtgcacctgagagggacaccccgtcccctcccgggagggacccgggcctgctgaagtgggctcaactctgcaaaccgcgtctcaactccccgcgccgcgccggggaacccctccctgacactcaacgcttcccgtcctcacatccccaaacacagtccacttcccttctcgtggcggccgcggcaacccgagcccggcccccgccccgccgccagagaacgcctccctcgccgggacgcggtgccgagcccgctgcacaccgagcggccgtggcacaataccgcggcgctgcgcgcacaatcaccgccccccaggacccgcggcgcgcaccccgggagtggggtgcgccccgcgaccctgggcgctcagggccagacacacctcttgggcgccccgcggcccccacagtgcagccttcatcgccccccctccactctcgggcacactcacccgccccccgccccagcccactcggcccagggcgcagccgctcccccgcgccccctccctcagccccggcaaaggaagctccccctgcgcccccctccccagaaccgcccccagcccctcgcccccctaaccgcagctcaacggccggcggcagcagccggagaaggggggcggcggcccgggccccggaaacggcccgatcgccgggatccgggccggactccgtacctgggctggaagcgaggcggagatgggcggtcgggatccgcgagtgagcggggcgggcggcggtgacagccccacagctccagctgctgctgctgctgctgccgccgcggctgcccggggagaggggctggcaccaccgcggcgcgtcactgcccggcccgggggcgggggtggccaggaggagggcccaggcgagcagcggcggcagcggcggcggcgccgcggcccggaggaagggggagggggcaccgggcacggggaggcgggagagggggcgggaccgggcacggggcgggggcgggggggaggggagcgcagggagggcgcaggcagggggagtaggaggagcagcaggaggaggtggcggaggggcgggtgagagggaggagtgggcacggggggaaggggagagaggaaaaggaggcacccagggagaggggagaggagaaaggagggagagaggcgcggggggagaagaggaggaaggagggggagctgggccaggtagggggggataagggcgcgctggacgcgccgccgtgcgcttcggtggggagcgcgctcttaagggggaagcgcttcgaggaagatccttgcacggggctgagcccggaaagaaggcgctgggatctgtgcctacccatcgctcccggaggctgcggtctctgggtccggtgggggctggggggagagggcacccggcgggctgtctgcggtcaggccaggagagggagacttggcccaaataaagtgactcaggcaccctcaggaactctcggcgcccggggccccttcgggcagccttcgacccccatgcgtctttcgggtccccagggacgcgggtacttgtggggcggggctgccgggcctcggggttcggctcccccgggcggccggagcgagaccccgggctgggaaagccaggcacgtggccggctctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgccccccgcgggcacccgagtgtccgggaggcgctcacctgttcgacccaaacatctacgcgacccccagcgcccgccgcccgcgtgcccgcccccgccccgccgccggtcattgtgctccgccagcccacaccgggccgggtcctgacggcgcgcgagccacagttgtaaagtaataggataatctcggggacgtcgctccagcccagacccgggcacgcactgtccgtggagacggcaccgccggggaggggagccacgcggattccagatgcggtcccccaggcggacagacccttgcccggggcgcaggaggaggcaggactggcatcgcggggtgggagccctggacctccgagcaacctcggactcggcccgaaaagcaacactctcatcaccaaaccgcagaattagaccccgatggagaaaatgggtcaggggatccattcccaccccacccctccaaatccagaccctccgctaccacagatcagcctcgaaaaaagcttgtgcttcaacaaggatggggaactgccctcgtggaattctgtggggaaattgccaaaaaaaaaaaaaaaaaaaaaaaaaaaaacaactaaaaaaaaaccctgataaggatcccacctcctgattcctctggtcgcatccgaagaggaagggcaatttctactgactctttacgctaccattcattcacggtggaaccagcagagaagagaaaacgagacagccacagcgattgtttgcaattttgaaacagactgcctttaaccctccaactttttttctgtaaaaagccttttttctttcttcctctgaaagctttgcattgtgaacaatccatggtaaacaaggctccctctacagccgcgagtgcgaagtacaaccccacaggttcagagcccagcgtttacccgtcagaaaaataaaatgatgacaagacatcacattagcgccacgcaggcttccttccgcacatgctcaagactctgctgtcaatagaaaactcacactttctttttaaaagagggtttaggcacatttactcatttgcaccttttattcctgaaatcaaatgtgttttcaaaccaattcactctccccagtttactggatcttctcatccttggtgatgtggggcaggtgggaggctttatttatccacacatgctggtgcccaataatgatttttagaacgaactagtggccacagctcttaagttcatccaggaaatgtgtttccaaacgcgggaactgtccatcctcactctgaaaatgagataattcagactcaggatttccctttccccaccacattttcagagacctttgacttctcctggcctgaattactatttcacagcagtggtggacatctgagcttgaaatataaagccaaatacaactgaagttcaaaggtggaattgaacccagataacccacctcttctctgactaataaaagagagctagtaccgcccaggagggcagagcagtgattttctgtaggcatgaaacgtgaactcatttactatccctgagataaaacagcccagccctgctcaacccacagaaaacagttgagagccctgcagaaacctggctgttgagcggcactgcaaatgaggtgagttttcatgtgtgtgtgctgaagccctcagaaatctcccagatccttattcctacaggagctgccactcctggagtaaccttgtataggttgttttcagtgtccttgtgccactcccccactccttaaagtggccacagcatgagtcccaatgaggaatcgggtgacctagtttcttgaccactaattctcccagtgatgtgtcccttcttctggccccagcctggtaggagaccatggcagagaaagctgatcccatctgcttcggggggacaatgctgccacaggtcccctccagcctctgaagacattgggtgcttttgtaaacagatgattagggtatgctctgatggggctttttaagcagcaaacccctttctttcatgcagcttcccatatgaagtaagcatgtcccacaagtggggacctggccatgggactctggtttgccattattaggacaaataggatcttagcgtgaccagagcagacactgttcaagcacgtcaaaacattaaaaaaaaaaattatccccacaaatgacttattaatgacagagaagaaaatgtacctgcaatggggcgatctggcagacacttcccaatcaagtcatcaaattcagcagcctccaaagtggggccaccagacatgatgtcctcggctcctgaagggaggcactggaagacacagcatcacttgagccatgtgctcccccaacatgcttcacctgaatctgctcctcaagagacaaccagacaagaaatccagaaagagaaactccacaacacaacagtcttggactctacaaaacattcattgtcactaattgactttctaaacgataagatgaaagagaaataacagccgggtgcagtggctcacacctgtaatcccagcactttgggaggccgaggcgggtggatcacctgaggtcaggggttcgagaccagcctggccaacatggtgaaacccagtctctactaaaaacacaaaattggacgggcgtggtggcacacacctgtaatcccagctactcgggaggctggggtaggagaattgcttgaacccaggaagcagaggttgcagtgagccgagatcataccgttgcactccagcctgggcgacaggagcgaaactccatctcaaaaaaaattaaagagagagaaataacaactaaacttaatgtgtgactcttcttagatcctgtagagatggaatgaggtgtggacaaggggtgggggagaggcagaggatgggggtggaatgagggtgggggccagggtgggctctgggctgagtggtcagggaagagctctcccaggaggaagccactgggtgtcctaatccccagagggcagaagttgacagctgggtgaagacctgggggcactgtcttccaggcagagggaatagttggtgcaaaactgctgatgaaaggaaaggtgaccagagtgctagagcaatgtgggccagggggagggcaggagggatgagcatcgggggggcaaacagggccaagcatgcaacatcctgaacatcccccgtgaggtgtgtgggctttacactgggagtgaggagaggatgcaatctgagttacgtttttagatcaggggagatgagattataaaggagcagaagtgatgacagggaggccagtgaggaggtctaatggaaagagtatcatcagatggaactagttcaaattctggctctgacactagatggatgactttgggcaccatacctaaacctctctaagcaacagtttattcatctacatgtgatccacagtttttgtttgttggttttatttttttttttttttgaccaaatcttgctgtgtcacctaggctggagtgcagtggcacgatctgggctcactgcatcctccacctccctgactcaagccattcttgtgtctcagcctcccaagtagctgggattacaggtgtgtgccaccatgcctggctaatttttgtatttttagtagagatggagttttaccatgttgtccaggctggtctcaagctcctggactcaagtgatccacccgccttggccttccaaagacccactatgtttaacgtgtgtttaacgtagcatttggcaccaaattttcctctttgagattacaaactgtggtagacagtctccaagatggcccatgatgaccctcaccgcccagtttcataccctggtaccatcgcaatgcacagggctgtggaaccaatggtgcattgtggaaatgagggtgtgtgactgccaaggctagatcctaaaagacatcttgatcttttccccagagggagtacttggtagatggtagcttttatcatcaggattgtacatttcataattgcacaatcggggtcacatccctctctctaaatgctacactagtttactctgccaccagcaatatctagcagcactcatttcactgcacacttgtcactgcttactattagcaatctcttttatctctgtcaatctgagggaggaagaacagtgtctcttattttcctttgctcctcttcacttgggaatgtaagtagatgtttctgtgcactgtgtttacggggcacttgtatttctttttctttctttcttttctttctttcttttccttccttccttccttccttccttccttccttccttccttcctttctttctttctttttctttctttctttctttctttttctttctttctttctttctttctttctttctttctttctttctttctttctttctttctttctttcctctctctttctttctttctgactaacctgttcatatcctttgcccatttctctatttgaattgttggtctttttttttttttttttttggtaagaactttttggaaataaggaaaattaatcttttgtcatgtattttgcaaatatgttttccttttgttgtctttttatttagtttatgacaagatttttttagccatatggaaattttacatttttatatcatctgattttttttttttcctttagggctttagggcttcaggttaaaacaaaagcttttttccactctaagattacaaaagtaattcacctatattttcttctggaaactttatgtcttcattacatttaaatctttattccatcttttatttatctcaatataagtaatgaagtggggatctggcttatttttttctaaatggctttctaagtggtgtcaataccatcttttatcttttattttttatttttgaaacagggtctcactctgttacccagactgaagtgcagtggcatgatcttggctcactgcaggctcaatcccctggactcaagcaatcctcctgccttagcctcccaaagtgctggaattacaggcatgtgccactgcacctggcctaaatatcatcttttaaataactcatctttatccactaattggaaatgtcatcttatactaattttctattatgtgtggatttgtattatattctgttgacctattcctgtctcagtattatggctttaaaatatgttttctgggccgggcgcagtggctcacgcctgtaatcccagcactttgggaggccgaggcaggagaatggtgtgaacctgggaggcagagcttgcggttagccgagatcatgccactgcactccagcctgggtgacagagtgagactccctctcaaataaataaataaataaataagtaaataagttttctggcctggcatggtgactcacgcctgtaatcccagcattttgcgaagccgaggtgggcagatcacttcaggtcatgagtttgagaccagcctggccaacatggtaaaaccctgtctctactaaaaatacaaaaattagctgggcgtggtggtgcgtgtctgtagtcctagctactggggaggctgaggcaggagaatcgcttgaacccaggaaggggaggctgcagtaagccgggatcatgccactgcactccagcctgggtgacagagagagactccatctcaaaaaaaaaaaaaaaaatatatatacacatatatatatgtatatacacacattatgtatatatatgttttcctactaggtagggctagcatccatctctaccccataaactgtccctgctcacaccataacaaaaataattgaaacagtgtcacagccaaggggtactctaggtacagcatatttatggagaaaggagagatgtttctcctgggggactggggggtgagagggaaggttcctggaagagatgacatttactgtgaatcaaagaagttgggaggcttgcgacaggtggaaagtagggaggcatccggctggaagaggaggatgtggagaatccagggcttcacaagtgcctggattcaaaacacctgacctgtgggctgggccatagcgctgactatccatttattctttatattaactgatttttgcatagctgcctgcaacctcacagtcagtttgacacctttgctgaaatctaggagaaacagtccaatactatttcctcattcttctctatttagataaattttccattacgaatacaactaactgagcctgacttgttgaaatacattctcctgaaaaccatgataaaaggtaaaaattacaatttcattattctccttttcaaaaagtcttgctttaaaatgtcatcagttaattctggtcatgtcgctctcctattccaaaaccttcaataactcccagtcaccggcggaatcgagttatagctctctctggtctggcgttggaggccccactggcctgctggccttatttccttctgttcctctctgggaactctgtagcagacggactcgccatcttttgtcccctagtcacccatgtgcgacccctccatgcctttgaccacacatgtttttaggcctgtgttccttccacacatatgtacagagccactaccacacaccaggcgccatgacaagtgcaggtgacatggcaatgtacaatacagactcagggttgaccatagggagcctccaggccagcaggggagagagagattaaacaagtgatgtcatgggatcctgatctgcatgctggtcatgggcggtgtattccagtttgtacttgatagtcctgaaacattctaggaaggaagtccccagggtgtgagaaggaagtagcagatctgggagggctccactgaggaggtgacatttaagttgggcactgaaggatgaatgggtgttcatgaggtggaaaggtgcctgggctgtcaacaaagacaccttccacctcagccaaatcaagatccctccacagactgccgcccagctggctctgaactgacgcgtttgtggtactttctgtttcctgcattaacttcattttccgaactgggccattcgctctgagggctgggacaggttcttagaagagttaccctgcacacagtagggatgcatcactgcctcactcgggccccttcctgcccactgccagcacagctctgaagtcttcgatagagctcagaatgaagcgggccatcctggacacgggccacactttgtaactcccatggggcatgcacatgcctcttttccctcccttctttcctggtgcccttggagaggctcagagaaactaccaaggccagccacaaccctgcatttctacttgcaggtgtgtacacaataaaatgaacacagatgttccctaaagaacacacagtaggctgggcatggtggctcacacccataatcccagcactttgggaggctgaggtgggaggatcacttgaagtctggagttcgagataagcctgggcaacatagcaagaccctgtctctgcaaaaagaatttagctgtgcatgatggcatgcacccgtagtcccagctactgtggaggctgaggtgggaggattgcttgagcctgggagatcaaggctgcagtgagctgtgattgtgccactgcattctagcctgggccacagagcatgaccctgtctcgaaagacagaaagaagaaagaacacatagcagactggtaggctggtcatagcagcactattcacaacagctcccaactgtccaccaatgaaggatggatacattgtgggccccccataccatgaaatattactcagccataaaaagaaacaaactactgacgcatgccataacacagatgatgctcacacacttatgcttgtgagcaaacgagcacatgctgtacaattccatttctataaagttctagaacaggcaaaatcaatgtatgctcctagaagtcaggtcagtggtcaccctggcccaggggcagtgactagagggagcacaaagggtctttagggtggtgctgatgttttgtttcttgatctggacatgggtcacaggaggtggggtcagtttgtgaacttggctgagctgtgaaactgagtgatgcgtgctcttttctgaatgtgcattatgcttcagtagaagtttcaaaaggggaaacagcaagccaggtcagcttccatggctaagcagcctggagctcgctgtagtcgattactgcaacccactggacaccaggcacctgtgctgggcagtgtgtatgtgttatcttatttaatccaccaaataacaaggttgatattcatttgccattgtgcacatgaagactaggggcttctgggagaagattaagtgactcacccagtcacccaagagtggagaaactggcactcagagagcaggtgacacgtccacaatcatggagctagaagctgctggctgtgctggaccaagatgtgtgggtctccagggtgtgtggtgggccctgctaaggtgagaccactgagccaggccacgtggtgctgcgcttcaccgacctccagcagagcaggaggaatccaccagtgcgagtcagatgcagccagagatttcccttgggccaagacctgggaatgggctaggactgctgtgaggccctgccttgggatggaccccagggcttctccatacaagccttggaaggaggctggccttggaagcctgaagggatgaaactctagctggctctccggcaggtgaggagaggtaaggaccctccacaggctgtgggggtgtgagactaacttacgttcactcggtccaaggaagccatgcagggaaacgggcaggttaccaagagaaagaggcaggcagcaccttctgcctaggcctgcagtcccttcatgacagagcccacagctccggtgtggatgatggcccaaggctctggggcccgggatgctgcatggggacctttctggggctgaatctagtgtgtggggtcatgtccaggtgtggaggggagtgggcagctgcggacacgctctgtttgcactcaggcccttgctcggtgtgacctcaggcaggtgacttgactctccaagccttggtttcctcatctctaaaatgaggaaacaacagcagggacttgtttttgaaggttgcagtgaggcctaaatgcagcgatagctgaagaggcctggactggtgctgggcacagagcaccgcccgaaccatagttatggatagtgatggtactacgaaaactaagtaataactcagtcatcagtccacacgcatttattgagcccctactatgctccaaggcccggtccaggtgcagggactgcagtggtgagataagcacacctgggtctgtccatgtggagccgatggtgctggtgctgctgcggcctcagcttgtccctaccctgactgttgctttctttttcctttctctttccccaccccttcccttgagaaataacagcattaagattggagagactagggctctctttcttactaattctgtgacttcagacaaattactggctaggcgcagtggctcatgcctataatcccagcactttgggaggccaaggcaggtggatcacctgaggtcaggagttcaagaccagtctgaccaacatggtgaaacctggtctctactaaaaatacaaaaattagctgggtgtggtggcacatgcctgtaatcctagctacttgggaggctgagacaggagaatcatttgaacccaggaggtggagcttgcagtgagctgagatcatgccactgcactccagcctgggccacagagtgagataatctcgggaaaaaaaaaaaaaaaaaaaaaaaaaaaaacacacaacacacacacacacacaaacaaattacttaagctctctaaagccgagcctcagtttccctgtgtgctgaggaactgagttctgtgtctgggggtacccagcacacagaaggcccccaacaattgctgttcctgctcccctgcctacctccctctcctctcttcttcctccccactttccccgtttcctttcttttccattctttttctctgcccaagccttcggcatcttaacacccaaagtgattgtcaaagtttagttgatggtgcccaggctgtggcagagactgtgaaccagttttcttgatattatgccctgaatcaacattctcccttatctttttcaaccacagagggtagaaacatgaaattctttctttcccagcctcccttacaactgggaaccacgtgacccttttgcagcaatgagacatcaacacaatgcctcgaatgtggacaaggttggagcaatagcaggcaacttgcaaccatgaggaaaagcctcaataacatcacagagacaccaacccaacattgcaaatggcaccagcggcggctcctccattcttcttgttttaggagtaaaataacttcatgttttgctatagtcaactgggtttgggggcctgtagtcaaaagcattcctggcttattcacatggctcctgtccgcgggtggactagatggcaaggatcccccactcccatgtggccttttctctttcaagaggacacaggagcctcttgactctttgaagaggacacaggggtgctacgctacgtccaggcacctgctgtgcgtactgtggtgcctggggagcagacaagcatttagttccctcacttgtggactctgaaggagggaaaactgtcacggctgcagcacaagtgtgcctgggcacttcctcagccacaggagtatcccagttaaagaacatcttctgtttctatcttatctcttgaggtatttagagccattctaaatgccagagccttagaatgaccatggggctggcagggcatgggctctgtgactcatatctgtcgaggaggctgcttgtggttgtgctggatcgagcccctctccttgactatcttcggcaccgcaagccaaagctcagggctgcccgggcctattcctgaggtggtgcaggagaggcagatgggctgctggggacgaaaggggtaggtaggcgggctctgggctccgtgcccagcattgccagcaacatgcctgtctgctgctgacccctgacccactcaacttcctccccagaagacagtcccttgaagaaaggggttcctccatcaaaatgtaaaatttgaaagccacagatgtctgacccaaacctgctgatctagtaacagggaagctgcagcatgaagaagttagatggctggggcgcagtggctcacgtcccagcactttggggaggctgaggtgggggaatgcttaagcccaggagttcaagaccagcctgggcaacatggcgagaccccatccctacaaaaaatacaaacattagctgggcgcggtgttgagcacctgtggtcccagctactcaggaggctgaggtgggagaattgcttgagctcaggaggtcaaggctgcagtgagctgtgatcatatcactgcaccccaataaaagaagttagatgactcgtggggcagaggcacacctagaaccagagtcgctggactccctctcaggtgctcatctccactttcgacctgagacaggcccaggtccctgccctgcttccctctggcagagaaagatcaccactaggcttcacatcacaacacatgtgcacccggctggcaggccctgggagagctgcctttgaagacggctcccaggcatagctcccccttactcctctatctgagccccactgctgttcctaccccagggtctttgcatgtgctgtctcctgtgcctggaaagccctcccacttcatctctgcagggctggccacttctcaccattcaggccttggctcggatgctgcctcttcagagaggccttcttgccctgaggcacagtctgtcatcttactctattttaattatctaccccaaatttcctccttttgcatatttttttatattgccttgtttatcatctccaggcctgtgagctcctagggatgggtaccttatctgtctcattcactgtggtatcttccgtgcttggaatgacctccagcatgtagtaggaacctcggaaatgatttttgagtgaaggaaggaagaaatttctttctttcttttttttttttgagagagtttcactcttgttgcccaagctggagtacagtggcatgatctcagctcactgcaacctctgcctcccaggttcaagtgattcttctgcctcagcctcccgagtagctggaactacaggtgcctgccaccacagctggctaattttttgtatttttagtagagacagggtttcatcatgttggccgggctggtctcgaactgacctcaggtgatccacccgcctcagcctcccaaaaagtgctgggattacaggcatgaaccaccacacctggcctaggaaatttctttaaaactacataatgctgtgttgcagggaggacaagggtctggtcggccgtgagcagcagctgtgctgtgtgcctctcagtctgaataggggtcggggagctacccgcctgccgggatccacacccagtcaccccgagcaaaacaaagcagacagcacaaattcacaaagcaatactgtgccctcctaccctcaaaaaaaaaaaaaaaaaaaaagcccgataatgaggtaaacacaatcatgaccaggaaaaagcttggccatgcttcttccagtccacccaaagccattatctctaattgatctccagacatcagctgctgaagcgtctgaaaccctcctgcaccctccaggtctggttacaaagccctggcccacccacccgccccatggagtcaggtctcctggagctgctctttgctgggggtgacagggcctatctgggccccacatgaaaaggacccatcaggctgacaagagtcagggtgggtcaagaacctgtgtaaaagtcacaaccactaaatgctcagctgccagggggctgagctgcctgagtttcagtgccttaagtagaaggcttgacaaagccatcaggggtcccgcattcaaaataaaaagcaaggaaaaccagggacggctgcagaaaagcaccctgcccaaaatatcccactagttctgggtgaaagaggcacccaaaagctggagtgaggagtttagttgcaaaacggaacgggacttagccacaagatcacgaatcccttctgggtcttggttaggctgtggcggtcacaagggcagccatcagtacagggaccatctggatgttttgagctgctccttcctggcccagcccaggaaagacgtctcctttcctgttaggtctctcttgtccttagaaacagaccggagtcagctccctgggctgcctggcaggggtgttttactgccagagctctgacaggacagagccacttccccccttcattcatggacgcccaggtagcagctcctgacctgtgcaagcttttcccttgacacacacaaagcgtcccgaggccagccctgcatgcagtattgctgcttatggcaccaggcagctctcctgcttgcaccagtaaattacgagtgcttcctgcattttttcccccagataataaagttgaaaggccaccttggcattctcgcatttgtaggggtggaggtctgcagcccggaaggggctcgagcctcaaggagctgctggggacaatgagctgttcaggttcggggtatctgccaaccccaccagacactggctctccagacagggtggtggctgttttccactttcccacacagcttcagggaagtgagaggaaagaaaagacacagacctctcccagctcaggttgccctcacaaaacagaggaaatgctcattttctgtgagaatttggaaattgtagtaagtttctagaaagcaccccaggatgttcaagaacatatactgattgcaaaaataatgtcccataacaaaagatgtttgacaatgagcttttcacgcctctctctgttctcttaaaaaaaaaaaaagctttctgataaatcattccctctcaagtttagaaatgccctattttcacagggcatggtggctcatgcctgtcattccagcactttaggaggccaaagtgggaggatcgcttgagcccaggagttcaagaccagcctgggcaacacgtgaagccccatctctataaaaagtgcaaaaaattagccaggtgtggtggtgtgtgcctgtagttccagctactcgggaggctgaggtgggaggatcactagagcctgggaagtcgaggctgcattgagctgtgattgcaccactgcactctaccctgggcaacgggagtgagaccctgtctcaataaaaaaaaaaaaaaaaaaaaagaaatgcactattttctttgggaggcccagaagttcaagatcagcctgggcaacaaagtgaagcactgtttctacttaaaaaatttttgtgtttgtttgtttttgaggcagagtcttggtcttgctctgttgcctaggctggagtgcagtggtgcaatctcagctcactgcaacctctgcttcccaggttcaagtgattctcctgcctcaacctcctgagtacctgggattacaggctcctgccaccacgccagctaatttttgtatttttagtagagacggggcttcaccatgttggtcaggctggtctcaaactcctggccttgtgatctgcccaccttggcctcccaaagtgctgggattacaggcgtgagccactgctcctggccaaaaaaaatttttttttaaataaatgccctattttgcatgataccattttaggaggatggggaatgctgtgctgtccatgtttagagccccccgatcctgacactgggctcatggtgctcctggttctcagtccacctctgtttgtcagtgaacaaagaggcctgggataaagtgtcttcacataatgctcatgtggtcagatcagtggtgctgctgcagtatttttcctccaccaaaaagcggatacaaacatttttaggcattaaagaaacaatttttggctgggtgtggtggctcatgcctgtaatcccagcactttgggaggctgaggcaggcagatcacttgaggccaggagtttcagaccagcttggccaacatggtgaaaccccatctctactaaaaatgcaaaaattagccgggcatggtggcaggcatctgtagtcccagctactcagtcagctgaggcaggagaattgcttgaacctgggcagcggaggttgtagtgagccaagattttgcgactgcactctagcctgggcaacagagggagaccttgtctcaaaaaaaaaaaaaaaaaaaaaaggaacaattatttttttcaaagtaatgccttttttcaagccagcaaaacttttaaaaagaaagccaacaaaagaggaacaattcctactagatattaaaacatatgataaagttttcacacttaaaacagtttggtagctgctacatgaatagtcaaggagcccagtggaccaaacagaagtagattctgttttggatggaaacttagtaagttttaaaggtgtcatctcaaatcagtgggggaaaatggagtatttaacaaatgatgctgagacaaaagggttaagcggaatctgtatctcagaatacgtcagcataagctccaaatggatcaaagattaaatataaaaaatgaaaataaaaacatgtatgctttttgctctgtcagctggaagagcctgcaagaaaggatacttcagtaccaatgggcacacatagtgcccagatcttgtttttttgttttgttttatacaaaatatatagagatgaggtttgcccaggctggtcttgaactcctgaactcaagagacccttctgccttggcctcccaaagtgttgggataatgggtgtaagccaccatgcccagccagatttttttttttttttttttgagacggagtcttgctttcttgcccaggctggagtgcagtggcacaatctcggctcattgcaagctccgcctcccgggttcatgccattcttctgcctcagcctcccaagtagctgggagtacaggcgcctgccaccacgcccagctaatttttttgtatttctttcttttttttttttttttttactagagacatggtttcatcgtgttagccaggatggtctcgatccgatattttggtttttaatatggttttccaataaaaggaatcagagctccttggagaaatcactgattccaggattggggcaggaaatatgcaagatgagcctggagtcttacagtgccagaaagcaaagaagcactaaaaaacaagaaacgaacaaacaaaaaccccaaacaccaatgaggtatggcaaaagagcacaggaaacaactgaaaaagctccaatggccaaagctagaacaatttgtacaacaaaatgaagaagtattgaatgatcatcaaagcataaaataaacagctatgagtctcgacttctataaatggctgaataaattaataagtgggggaggagaaacaaatctcctatgcataagcaatctaaataatttacgttgataattcaccctaaaaaaggcagaacatgactccccactcttcaggtgtgggctgcacacggtgccttccttcccaagtgcacagtgtggaaagagggaaaagtcacttgacaggagagaaacctgacaaccaatatctcaaccaggtgtgatcaaggccaatggcaacagtcctaaatcatgttgatattatggacccttaacaggatgtgatgaaaatgacactccatgtctgtggtcttcctcctaataacccataaccccggttttatatagagaaaaatgtcaaatttctaaatcctacaaaatacacaactagtactcttcgaaactgtcaaggttatcaaaaacaaggaaagtctgagaaactgtcaaagcccaaagaagactaaagggacatgacaattaaatggaattaaatgttacaatgaaaattaaatgttgtatcctggatgaaatcttggaacagaaaaggaaattaggtaaaagctaaaggaatctaaataaactgtagactttacttacaataatgtatcagtgtggttcattagtggtaacaaatgtatcaccttaatataagacattgataatacgggaaactgtgtgtcgaggagtgggcaatgtggatactctgtactatcttcccaatttttctgtaaagttaaaactgttctcaaaaatagtctatcaaaaaaaaaatgaaaacataaaaatactaaaagaaaacatgggggatggagtggagttagcctttttaagactcaaatgcagaagcgatttgaagaaaaaattgatacatctgagtacataaaaataaaaatgacaacacacacagcataggcaatatcaaaagagagagagctacggatggggaaaaggaggcaatgactaactctggggaatccgaagaaaggaaatgtaaggaaatgtaatcatagcatatgttaattgggtcagctatgagtaatatgcacacagtcataataatataaacaatgaatagcaatttatctaaatagagaggtatagatatgttgcaggatggaggaaggagaaataataagtgtatttatgagagggtgtaagagtgcaaatacttatttcctacagcaagaaattaacaacaacaaaagccccaattgaaaaatcaagaacttatagtataagcaggttattccaaaataggagttaaataccagaagagacagctaaaacataagaaagaaaagaggctgtccctagggagtagaaattgaagtggggaggctggggcagggtctgctatttttctatatgattttaaaaaatgtattctagaggccgggtgtggtggctcatgcctgtaatcccagcactttgggaggccgaggcaggcggatcacctgaggtcaggagttcaagatcagcctggccaacagggtgaaaccccgtctctactgaaagtacaaaaattagctgggtttggtggcaggcgcctgtaattccagttactcaggaggctgaggcaagagaaatgcctgaatccgggaggcggaggctgcagtgaggatcacgccactacactccagcctaggtgacggtgagactccatctcaaaaaaaaaaagtattctatctataaaaataaaaataatgcaggccgggtgtggtggctcacccctgtaatcccagcactttgggaagccgaggcgggtggatcacctgaggtcaggagttcgagaccagcctggccaacatggtgaaaccccgtctctactaaaaatacaaaaattagccgggagtggtggccggggcctgtaatcccagctactcgggaggctgaggcaggagaatctcttgaacttgagagcagaggttgcaacgagccgagatcacatcattgcactccagcctgggcagcaagagcaaaactccatctcaaaataaaaaataaacataaaaaataaataaatgcaaagaaatcaaaacaagttaaaaaagggtaaagggccacccagaagtgatttctgtaggtgagctgccctgggattgcggtggaaggtctgggggcacaaggtagaagctcacagcggcttctccaactgtatgtcctctcacagcagaaatgctccaaggattgtcctctgcctagagaaatcccaacagcagccttggtcaaggacagtatttcagctgcttttgttttcttgctgcagcataaaccttccacagggccagaaatttactgagacaggatgaaggtttgggctatagattctcagatactgaaaatgtggtcgatggcatttcaggcctttcccgtgctctcatggtggcaggttaggcccctgcagctcagctacacaacaagaggaggtaatagatggagcaaaggaaagaagccagaagcggacaagcaaggctgggagtagtgaagacagttggtgggatgggtagaagctcgggaggctgggaactgagagggaagtggtggcctcagtgggagagccccatggggagagaatgaggcagactaaaatctaggcagccaaagcagcagaccccatatcctcacaaatgccacagggtctaccccacttattggtccatgcacattttcaggagcagacacagatgctcaaagtttgaacagtctagagaaatggctattccaagacagtagcaaaatctgcaaatggtgaaaagagagtggagacggcaaagatatgctgagagctagaaagattctgcctcttacagcaaagcttaacagccctcctcacctccccaatggcagacctccaaggtctggagtgtcactgggaaactgtctttgatcatcataaaatatcacactttgccctacttaatgctttttttttgccttgaacatttatttaacattaatagcactactccctcttttttaattttcctttttgtgtcattttgataaatgtcttttgtaaatacccaatgccatttaagaaggcccatctgagctttttatgatactgtgtaatgaaatttaacccattcacattttttatatttagtagtttggtgttgtttgtattatgttactttatgtaatttattatatacatttatcatattcctttatatttattttatatgtatacataaatctcttttttgtggtttcttcgtttagtccccatgtaatcactcttgctggactgattaagttttctgtgtttcttttattcactctactggtttagaagttctacattctatttctagtccatggagattactctttaactttaaagaaacatctcagaggccgggcgtggtggctcacgcctgtaatcccagcactttgggaggctgaggtgggtagatcacgaggtcagtagatcgagaccatcctggctaacacagtgaaaccctgtctctaataaaaatacaaaaaattagccaggtgtcatggcgggcgcctgtagtcccagctactcgggaggctgaggcaggagaatggtgtgtacccaggagatggagcttgcagtgagccaagatcgtgccactgcactccagcctgggtgacagagtgagactccatcaaaaaaaaaaaaagaaagaaagaaagaaaaaaacatctcaaaacctctgcagctgcttttttttttttgactgagtcttgctctgtcgccaggctggagtgaagtggcatgatctctgctcactgcaacctctgcctcccaggttcaagtgattctcctgcctcagcctctgagtagctgggactacaagcacgtgccaccatgcccagctaatttttgtatttttagaaatggagtttcctcatgttggccaggatggtctcgatctcttgaccttgtgatacactcgcttcagcctcccaaagtgctgggattacaggcgtgagccactgcaccggccacctctgcttctttaagagaccatcaaaggtcacacacattgagccacagcaggagacaaggccatgtttccattctgctattactcctctgaactcccagttcacctgggctgcagggcagcctgaggaaggaaagaagggaatcatcactgctatcaggctcctaaacatggagcctaagtcagttagacttaaacaggttgtctaagtcagtactcttgggttctccatggtaagaaccccatgagtcagcactgtttgagtaagtgacagtctctcacagtaacccattaacactccttctcctttgtgtctgcccatattttgggggtctttctgggcaggggggagattgagagggttcataagaaagagaaaagataatgattaaaaagtaaatgtagttagccaaaaaagtggaaacaacccaaatgtccatgaacagataaatgcagtaaacaaaatgtggttaatacaaatacaataaacaaaatgtatggttaatacaatgaaatattattgtcataaaaaggaataaagttggtcaggcgcaatagcacacatgcctgtaatcccagcactttgggaggctgagatgggcagatcgcttgagttccagaccagcccagacaacatggcgaaaccacatctctacaaaaaaaaatacaaaaattagctagatgtggtggtgctcacctgtggtctcagatactcaggaggctgaggtgggcagattgagcccgggagggcaaggctgcagtgaactgtgatcgtgtcactgcactccagcctgggtgacagagtgagaccctgtctcaaaaaactaacaaaaaggaataaagttctgacacatgctaccacatggatgaaccttgaagacatgatgcacaaaaggacaaaaggacatctgattccactgacatgaggtgcctaaaagagccaactgcacagagagaaagcagaatagaggttaccagggctgggggaggggaggaaggggaattattgcttaatgggtacagagtttctgtttcgggtgatgaaaaaattttggaaatagatagttggtgatggttgtgcaacattgtgaatatactcaatgccactcaattatatacttaaacgtggttaaaatggcacattttaggttttatatatttatcacagttttcttaaaaaaatgaatgtggagagtttttcagggtgggcttgtttccttctccatttagggggatggaagcctgagaaagttcctgctggaaatctgaaccttgatccctagtgctgactgaggaagcgctctctcctgggcctggcttccaaggagggggcttcctcggagtcctggcctccttctcctctgttccccaaactggctccagcctcccctggccccaggtcctgctccagctgttacctctcagcttccctcacccaggccctctctgcttgcccaagccaggcattttaaaaataagccaggcccggcacggtggctcacacttgtaatcccagcactttgggaggccgaggagggcggatcacctgaggtcaggagttcaagaccagcctgaccaacatggagaaaccccatctctactaaaaatacaaaattagccgggcgtggtggtgcgtgcctgtaatctcagctattcaggaggctgaggcaggagcaccgcttgaacccaggaggcagaggttgcagtgagccgagatcgcgccattgcactccagcctgggcaacaagagcaaaactccatctccaaataaataaataaataagccagtgcctctgaacttcctggcactagccccttctgttttctgtcccaggtgacagctctgtggctgctgttttgtcccctctactaagaagagctcactgtctgtgaaggggtctgctcctcctcacctgccctccaggacccaaggaaaattctgggccaggacagaacagtagaggagagggaggcagaggttaatgggggcaagctagaacctccatcacgtgggctcagacaatggagctgcaccacttcacacactgctgtgaggaccattaaaaccattagcgggacattagctctgctccaggaactgcagagagggaggcaagggaggtgcccacagtcctccagaggtgagccctgagcctctctgggcctcggcttcctctgggtgggagaaggagcacagttgtctctctgcttccacagctaatttctacaaggggcctgaaatcttccttccctgccccttccaagaagatggctcagtcctctgtgcaactaaatacaatttccattttatatctttttaagagtattcccaaataaaaaaactctttgatcagaccacactccactattttctgctcagtgtggccactttgatgacagctcttggggtctgtgtcttaggctggaggtgccgagagggtggagtctaacccccatagcggtgccttgtacattgaggacactataaatattgggtgcactgaaccagacttcaagaagaatctttcttctttctgtgaatcttgttattgaattttcatattatctaataccctctgcagagaaggactcattttctagcatattaatctgatacaactggcctacaagtaacatgattctgtccagccctcaagaaaatcccaccacctgcattttgatcaaagcaaagtgagggaaaatgttctccttatcttaccatttgtctcttggatacgtgatgttggaaataaacagattattgagattttttcttacccaaagttttcagatatagagctttgttcagcattaataaaatatttatcctggccgggcacagtggctcatgcctgtaatcccagcactttgggaggctaaggcaggtggatcatgaggtcaggagttcgagatcagcctggccaacagagtgaaccatgtctctactaaaaatacaaaaaaaaagtagccaggcctagtggcggcctcctgtaatcccagctactcgggaggtagaggcaggagaaatgctcgaacctgggaagtggaggttgcagtgagccgagatcgcaccactgcattccagccagggtgacggtgtgagactacatctcaaaataaataaataaaataaaataaaacaaaatatttatcctggttaccggttactttagaattggatttattttccatgtaacctgcattagaaatttgcaaacactacagatgtcctcttttggcattttgtggtcagagtgatgaaatgaaaccactctcaaagccttgtcttgggacatcggatttgacagcagccgaacctgtcctgcggctgtgtttggatggtggggagtcattcgcccaccctggcctgcctttgctgcacaggaaataagctagtaattcaagtatatgtatttttagttctaactcaagctgaagaatcaaagactgctgggtccttggcccttccttgatgctgcagataaataatctggtgagccatgtgatttcatcttgcgccacgtgcccagccataaaacagggataacggcactgcctaagaggctgaggccttgagagctcattgctttgcatggagtgctgaagactgacagatgaagggctctaggcatgaggcgggaggctgcttcacctgccaggtggtgaaaggcaggcctgaacttccatctcctgccgcactcagaagaagctggctacattcagaggcccccacctggaaactactaatgaagctgaggaagtcacatccagccccactgtaagcagaggccacctcgatcttggccctgccccagctggactcccagaacaccctggagacaaatgccctccacagtcctttcttcctttgggagctaccagagcctcaccagggcaattcctgcatctcaggtcatgaacttcggttcatcccctgatactcatcaggtgcttatgcacacaacactgtgctttcccccttttgcttcggcaacagaactcctcacattctctgctgcagccacaccagcccctcaaatctcttgaaggcttggtcctcccttgagccacaaggcctttgcataagctgttcccttggcctggaactctcttcccctcagattccactctcagctgaagctccctttctgaggcacagcttccctgacccctgcctcagtccaccctccaagcccaccctaagtacccccagtgccacgtgtccttctgcaccatggcaatgccccactgatcacttcctccattgtttatcactgcctgctgtgagctgggcatttgtgtgggatcctctggctggtgtctgtctcccctagatcagaagaaaatacagggatgccagccggaatctcagcactttgggaggcctaggcaggcagattgcttgagcccaggagttcgagaccagcctggccaacatgaggaaaccctgtctctacaaaaaatacaaaaaattagcaggtgtggtggcaggtgcctgtaaccccagctactcgggaggctgaggcaggagaatcacttgaacccaggaggcagaagctacagtgagccgagattgggccactgcactccagcctgggtggcagagtgagactctgcctcaaaaaaaaaaaaaaaaaaaaaaagaaaagaaagaaaatctaggggtactgctgtttctgtaaatcctcagagcctggctcacagaacagagctccataaatatttgtggaatgactgaatcctcgttaaagcacctaacccatagtcttaactcccctccttccattgacgcaagtgaagatacagttaggatttttaaccagatcaaatatctgatttgttagtgagagatcgcaacttgcacgacactgaccactactggttctagtggtgacctggatttagtgccattctgtatgaaacaaaaccagggggctgtgcttccggctgtttgtgcggttttgtgcttcattcttcatgggcacagatgagcacggtgataacagtgtttacgaagccaggtgccggagacagtgaggatggctacaggaaagaaaggccacagattgctcttcagtggcagtgagaggagacctaatgcagaggctgcacagtggtgctgggattctataaccaacaacaaaagcaacaccctcattaccgacactcctgcagctcaaactactttgcctttgtgcgttggaaacccaacccaagcccattttccccactggaattatttgtgatgatgtgaagtttttggagatgcaaccatcccagaacaggcacgctcagatgagaagacgtgggagacacagttctagcaaacagttctaccgctcagagcaaagcctacgtcacacagcctctagggtctgggcacagtgtggggacaggagggctggccgccctgcctcttgaaaggaatacgcagctctgcaggttcaagccacccagctgaagtcctcaaactgggtaacacgggccaagatgccacctgcacgtgtcctgctacatcaccatggatctggccaaggagccaccaccccctcggagcacgcatgctggggttgtcaaggagaccagtgcacaggacggccgcacccagggctggagaccggcagcgcaggacagctgcatccagggctggaagacagactcgagttctgacccatctttcaatgggagagaaagaatccaatcccctgctagggccacaaggacatgatgggtttggatgccataagagatgagaacactccaagctgaaggcaagaagtgattaccctggttttaggcagtggttggggggtggaggtggaggggaactcacctagtccttctttgaaagacagtcaggctacgtgctttgcaaagggttaggaggtggactgtgtgggaaggcaggcgagagggagtttcttttcatagcctgtttccatggtgtctcacggcccttggcaaaccccagctggggaggcttggacggccaggaggccccaggtccaccctccaaggactatcccctagtcctctgggccccaagagtgacagaggccacaggcaggcggctactctctcttgcctccctgggggaaggtggcaagaggccagcgataaagggcagagcagagaaagaacaactccaggggccagggctgcggctccctcccttccacgtcccctcctccccctcctcccacgagcccacccaaggggaaagttttctccctgaagacctgcagggctgtctgcacaggagaccctctcacgagaaacacattcttgcctcccgcctctccgcctggacaacccagataaccagataagggcctctttgatttcccgtgtgtttacacaagctgtggccccaagtcttggaaagaatcaaccaccgccaggcaagtcaggacgcctccaggtggggtgaggggagacggccgccttacctgctcctgggaattcatcactcgaagcttcatctgcttcaggtaggtggaggtgaggggcatgttgtaatcaataatcccagagaccagtggagatggaggctcgttttctggcagaaagaacaaaaggaaagccctttcagtctgtgctgcgggcctgttgcccacatggagcatttaacagagcccgtggaagaggaagccaccttggaggagaagggacaggtcagaggtcgcagactctgtggctcacccacatctggcccagagatgtggactgcatggtgtcaaaaatattttttttttattaaatgccagtgttctatttagagatttcacacgttaaaaaacaatgaggccgggcgtgctggctcatgcctgtaattccagcactttgggaggccaaggcaggaggatcccttgagccccaggaggggacacaggccccaggagttcgagaccagcctgggcaacacagggagatctcgtctttacaaataataaaataaattagccagacgtggtggtgtgtgcctgtagtcctagctacataggaggctgaagtgggaggatcgcttgaggccaggtggtcaaggctgcagtctgcagtgagctgtgatggcaccactgcactccagcctcagcaacagagtgagaatctatctctaaaaaacaaacaaaaaaacccagcaaacccacccccacaacacacacacacgtttataggaatttttggcttctttgaagaacataaggtctggccacatggggcccccactcccgaaggcaagcaaccactgccacttcagcagccacttcttttagacagggtgtgtggctcccattttgccacagtccccaccactccttatcatattgcacagctttgctcatttgcaagtatcaattatgatacttgccagacccttgaaggcatctgtgtttccaaccactgtctaagtcagttatcttccaggtgaacacatgccactctcacctcacccaatcccgccaccccatagcatcccccaaaaacatcctcaggtgccttatgcctcccaggtctgagccaggccttcagtagcccccaaattctggttcctccttcatcatatgcagaggaacattctcctcccatttattcctttgttgtcctgaagatcaaagtgatgcatgttctttttgcagagaatttgcaaagtacagaaagatgtaaagaaaaaatttaaaaaccataattgcaccacgcagcttggcatatgcttctgtttattttttccctgtgatttttcttttttacacatgatctcataatgcatacagagaattccagtctgcttttaaaaagtttttttttccttaacattttgtcataggtattttccccaacatcaagaatcttattttgctttgtaagtagaatttttatggccatgtaatattttaccataatttgcttaagtcattctctaacgattggctatttaggttgttcccattggggctattataaacaacactgcaggggacatctttgtgcataaatattgctccgtatttctgatcttatttcttgcctttttggaacagattacaagaaattaaaaggtagggacataatttgataaccattaaaatctctgaccaagctgctgtaggaattgtttcaattacttgttacctggcctcctcctccttcttccaaggacttcaggccagattcattttgccccagccttttaatcaaaaggtgcccctggtacatagtcccactgatgggctgggatttccatagcgtgaggaaaagtgggagcaacttccagaccaagtgccctctaccatcacaaggaggcccaagagacaggctgcagggtgacagggccgaggtccaggaggaccagaggatatccgggggtgacttataatacctgcccctcaagagccatagcccaaaagggtccctgcaaccttgaaaacgcgataccaagggcaagaagccagacataaaacgacaaccactgtatgattctacttacacgaaatacttagaataggcaaattcaaagagacagaaagtaactcgaggttactggggactggtggctgagggaatgggacgttattgcttaatgggtacagagtttctgtttagggtgatgaaaaagttttggaaatagatagtggtgatgattgctcaacagtgtgaatataatatctttaaaatggaacgattaagccgggcacggtggctcacgcatgtaatcccagcactttgggaggcagaggcaggaggactgcttgaccccaggagttcaaggccagcctgggaaacatagtgagtccctcgtctctactaaaaggtaaaaatgttagctgggtgtggtggcacgtgcctgaagtcccagctactcgggaggctgaggtgggaggatcacctgagcccaggacgttgaggcagcactgcgatccagcctgggtgacagagactgtgtctcaacaacaacaacagaaacaaacaaacaaaattattaaaaaggcaagtttttgtgctgtaaatgttttaccataatttaaaaaggaaaaaaagtctgccaacaagcggtgaagttacccaaagaggacaagggaagttcctgcttggcaaggataggaacagccctgcagaaaaggtggggacccggaatagctggggcctagaggatgggggtcctctttgacgctgtgtacttctggtgactttatagatcaaataacattttgaataaagttttacaggaatgcagaacttagttttgctctttaaagctaccctgtcacatatagaatgtttcattctttgttctttgaggaagaagtagacgtcggctgggtgtggtggctcacacctgtaatcccagcacttagggaggctgaggcaggcggatcacccgaggtcaggagttgggagaccagcctgaccaacatgacaaacccccactctcctaaaaattcaagaattagctgggcatggtggcgcatgcctgtaatcccagctacttcagaggctgaggcaggagaatcactggaacccgggaggtggaggttgcagtgagccaaggtcatgtcattgcactccagcctggtgacagagcaagactccgtcccaaggaaaaaaaaaaagtaaatgtcactaatggaatggctaagaaactggcctgaaaggaaccaccccctcctcctcctttttttaagagagacttctgcttggttgggtggcagggatcctctgcaccgataccaaactcaaatgggtttccaccccaccgtcaacctagatttgactttcttaacctcagtggggttttaaaccctagccccatacattgaccgggtcggatgccacatgtcaggcaggcagtctagtgatgacactgagatggtatcgctcagaagagccgtgggtcctgttttcagaggtggatgtttggactgagaattctgccatttctgtttcctctaagaggaggctgtctggtgagaagctgttaagcaccatggtgagtgtgacatcatggtgagtgtgaagggcgcccagcactctcgcggccccggtcggcccttcgttgggtgttgcagggattgtctaggtttgggaggcacggaggcggggagctgtgttcttctactgatggtcgcccctgtcctgactgcagtgtcatgactgttcatgagaaagtatctttaataaagctagtgacagtgtggcttaggaaaaataaaacagtggccaggacagcacccttgggaggcgtgagaagaggtcttccttggcctgttcccaccccagtgtctccagagatgagaaaccacttcccgtgcctgcaggtaagccaagagagctcagaagaggaaggcaggatgtcctggtcttggggaagctggaacatcccgagcagacccctaaacccatcggagaacaccttacattgctgtaaggtgaaatgcttgattttgcagttccagaatgagagttctgtgggggagggaggacctccgcagggaggggacattctaggtgaggaaatgagccatggagccatgggtgggaggtcagagctcaaccacaccagggtgaggagaaaagcaggcaagcttttcagcagtgaggagccccaggtgttctggattcaataagtgggtgcacactgagaggatgggcttagtgggaaagagacggagcaggggccagtggaagccgcagagtcagatgctcaccagtgagaaaaacgccaggatgggggacaaggtcaggtggaaacgtgaacaaggaagaagtgggttccttggactctgagacacgccgcccccctccctgcccatggtcaacatgtggtgccacactcgagcctctacaaatgacctgatagtgcggcaccgctggactctgttgccatggagaagggtgagctaggagctagcaagggtcacggagcctaaatcatccagcaggttgctggcaagagaagcacaacaagagcccagagagatctttcaacatctctttgccaagaaaaatggaaaccagcccaggcactagacctagttttatgcagtctcgagaataatcaatgatgtgggtgcttgggccaagccaggttgtttgctggcctgtgcagctgggcgccaatggcactcatcaaccaatgcaaacctcaaccatgggagtgaccctcatttcctcgtgggaacaccaggtggtgatgctcacaagctttcacctacagcacgaagaactctcagtccagagacaggtatgaaagatcttccaggcaggggtgggcgtcgaaggatgtgtgcacgatgggggcctggcacagagaggccgtgagaccagccagcctcagggggttcaaatttggaaacagagatcccaggcctgagaccagctcaaaaggtggcaaaaaaaaaaaaatctccttcctggggaagtaaatcattgaattggcaagtcttcgaggagtgctgatgtgcatgctatccgggtggggaacgtgaggaaactgtgtgcggtgcagtccccaggctcaggaaacaagggtgaaggatgagcagggtgcgacagacgtgaggccattagggtcactggaggaagagctgagagggccccggagtcgctcaaggaagcttcgtagagagaatcggaatgggactcacgaactattgctcagctgacagctccttagcacctgcttagggctccacacacacactctggttagaggctcccaggaaccttgtgaggtgggtgctcatagtaataccctgactttacagatgaggcaacagcacacagagaagctatgcaaccttcccacagtcccacagcaagcaagtgtgagagccgggagaggccaggctggcaaggagggatgtggaggggccaggcatggagggccttggaaaccacgcagaggagtctgggcctggttgtgaaggggtggagacccaagtggacaacctgcctactgaggaagagtcagcattgctgcccattggctactcccagtttgcaaccatgcaacaatattttgtcacatcaaagaaaacagagacatgcctccaaaggtccctttccccaagagctgggctggtctaaagtcacacccactttgcatgctgtgtcctcaattcctcagggactggtggaagaggagtgtggagtcaggaggtcctggaatttcccgtcctcagacttcctgatcctctgccacctcctttgtttatgctcctggcactgggggagggcacggggctgtccaggtcccccccactctgctggggagagaccgctgagcaaaggaggccactctacttcctttctttctttttaacataaggccaggaagccaggcattctcccagcagccctcaaggagcctccatcctgtcccctgtccccgctccctcccaccttcctggggcaggaacactgggtctgcctctggggctggtgcaggctctgctttcccagcagctggagagggagaagggagggctggcaatgcaggggtgcctgggagacagcaggctatagctgcatccagtggccagcatggcgggcagagataggatctgcaggctttcagcgggggcaggaggaggggaacctggggacggtccaggaggcgaatgcctctggccacttagcagacagtggagcctttcagactcaaaactctccactggcagcttccagaaaccaggcctttcccttctaaccctgtccagggtgtggacccagcatgcttgcctggcagggctgggggccacatctgaccctacctgggtagaggcagaccttgtgtctctgttgggccacctggacgttggcagccttgtgtctgggcaccgtaggccacgacacgggctggaggcaggaggcagggtgatgctccccaggcacccgctgcgtcccaggtgccctccacaataggctcaccctcaccaccctgaaaggatggcattccttccactttgctgatgagaaaatatggtttcctgcctgcacttctatctcctgggagagcttggatgtatgatttcacctcaacacctctctgtgcctcagtttccttacctgtaagccaggactaacacctcataggatctttgtaactgtcatgatcaggaactgctcagagaggttccctgtcctgccgagggacacacagtggggaacagggctgcacaccagacctgcctgactccaagtccatgcccttccatgagccacttccccgggctcctgctccctcagcgtcttctcctctccctgcgaggagaagctccgctacctgggacagagatggcattgtgtctgaggatgggggaggatgggtgagaatgggcatggtgctagtcttctgtccagcctgaagaaagccccaggaaagatgggcttcagcgctggtttatattctagatggctcctggcctgtgtgctccctcgctccctggcctctttctcctccctgggggtggggtgtggtggtggcagccagcgaggagaggaagcaggccactgctgtgctccgcgttgccctcctggccacacagaagcccacagatgaggagtgcagcctgcagcatggggagacctcgcagccatcagtgaggagtgcggagggagctgaggaatgccctccatactgccgtgggatgtgtggcaggagaggggagcggatggcgcctcagacaccccagagcagcccacaaatggagcccctcttggcttcgcctctgttcctccaggcaagcaattctgtgtctgactccgccagttgctatggaaacaatgaggaaaggaacgggaggggacaggcggatgggtgggcaggaaccaggcagtcaccactaggacacacacccctggcccctgcggcctaaaccctggcagggtggagagtggggcagggaaagccctccagcccatctgcaggtaccaaatgctgtcttggcccaggggttgcagctgctgcctggccaggggcagcccacgtgggtggcagcattcaggatcactggctcaggcatgcatcgagggagtgtccagcattataacaggaaccgcaacagccacagctctctcttcctgcaccaatgccaggtacagggactaacccatatcttgtcagccttctgattaaccccatttcacagatgagggaactgaggctcagaaagatgaagtcccttgcccaggacacacagcagctgaatggtagtgcagccctggagccctgttcttaacatgggaaccagcatttatgagggattaactagatccattcctgcccctcgtgctttgaagttggcccatgtgcccaatgaaacagccgtggcctgatggctcccaagggcatggaagcctctggatttggtgagtcagctgctgtcagaagccgttcacgtgtgtcagggacaatgaacacaagcagaaagccccgcttgacgcccatgctcccaatcctttgttgtctgctcaggctttgctgtggatttttccttccccagattcaatggatgctacttgagtgccacccggataaacggcgcgcccttcattcgagtctgtttccatcctcgggcctgacttcagcaacttccacaggcccgatgcccgggagctggcatgatgcaccaggcagtcctggaaaccctgataaatcgcccacctgggcaccatttctcagggcagcattataattgtaccagccaaatgtgctgggccgtctcaatgtgccaaagccacctgcaaacagatgggcccccagatttcctggaggcctctgggatgttcagtttgagggggtgcgggggtgctgaagtgaggtccttgctggtctcactgggcaggacagagctggagggcatggacgtcagtccaagggatcacctttggtggtcacaagtgctctgggcattttattttattgttttttgagatggggtctaactctgtcacccaggctggagtgcagtggcatgatcatggctcactgcagcttccacctcccgggctcaagcaatcctcccacctcagcctcccaaactgctgagattacaggcatgagccactgtgcccagcctgccctggtcattttaaattctcatcagtcggccgggtgcagattacacacctgtaatcccagcactttgggaggccaaggcgggtagatcatgaggtcaggagatcgagaccatcctggctaacatggtgaaaccccatctctactaaaaatacaaaaaaaattagccaggcgtggcggtgggcacctgaagtcccagctacccgggaggctgaggcagaagaatggcatgaacccgggaggcggagcttgcagtgagccgagatcgcaccactgcactccagcctgggcgacagagcgagactttgtctcaaaaaaaaaaaaaaaaattatcatcagtactccgtgggtttacttatcagaggccacatgggtgtgcacagggtggaaacaagcaccagggaagatgtatcattaacaggtatgtgggtgggaggatgcatgcacacgtctcagggagggtacaggccagaccctcgtgcatggagaagcagtgggaggcatggatggaactttgagaacggggcaggctggccattcccaactggaatccggctgggaggaaaggggctggccggggccttgcaaggcaggggaaacatgttgttcacttttttgttttgtatggttggtttttaagtgaaatttgagatttaaaaaaagttaaacgaaacaaaacaaggcgctttgggcagcaccacggacccatactggcctctgggactagcaacaacagctgctggacacttttctgtgccagcaaaagctggcgtcttcagggacagtccactcttagatggcccccgccctagccctccagcacgccacccctgctacctttgggttccaggccattggagttaaagtgcatcctcttctgacactccgtacagctcatcaggaaccgggtcacggcctctctcgggaggaaggcataggtctctgcgatctggaggagagaagagcttcgcttgttatatggatctgtggggaggcaacttggccatggggtcaccaaggtctgagctttggtggcaggtgcttcggctcttgcaaggaaagtcagggatttgaggagcaagggacaggtgtcctggattctcagctgtggcaatgagacagtacttttgtggaaaaccatttgttttaaaaatcgcaataaaggaggttaaaaattgaaaaagcaaaccctttaaacattatctagtctttaacctatattctaataagtaacattcctcagaacattttattgctgctacaaaaaaatgggcttacaaacattgctctagcgtagggtgagcagttcccctcttagagatggatagactgagacccacagataaattcactgccccaggcccatacacagaaccaaaggtcctacaagccatctcctgtgatcactgacaggtcaagaaccttcttaggaagagctgtgaagggctagtaccaggcatcagacttttcaaactagacaggctctgcaggacccccatgttccaggcaactatggcttggagaggtgagctgactccccaaggtcacaaggaattttcaaggcagtgccagactaaaccccatgttccaggtcacaccactccacagttgcctccagaaggcctcccctagttgaggaggaggacagggatgcagagggctgggggagagacacaaagaagggagggaacatgaaaaaagggctgggtgggggagtggggaagaagtggctgtgggcctaggtgtccagccctttcctcttgctctgggttttggaaaagccactgaccctgatttagctgtctggtggggccaaagagtcccttcagtcccaggttccctgggctgagactgcccagttactggttttccatgtgcttcctggagcctgggtcctcccgcacctctccactaaggggcagcatcacccaagcgttccgctgtcctcgccgcagcccgcagccgggctgggaaagttggccaagggtgaggggctgctctgcgctgcgcttggccccgccttcccacagcaactgcaggggtttgctcctttagaaatgcacgaatgtccttctccatctctgtgatggctggagggtagaggtgggctagggcggggctggggagtggagttgtggggggatgcagaaggcttggggtgtcccaggctgtggctgggctcttggaggaccagctcaggcacagcttccagctcagcccactggcagagtccaggggccactcttgccagctgcaaatgcgaagttaattttggtgacacaattgttatttctcagctgatttgatgctctgtggagcaggcaggctccttgatgagttatctcccttccaaattccctgtctgattgccttcctctggaggtcagggacaagggcaaaccccagtgtctctgactggagcagcggatgggagagcaacatcagggatgcagctggtccttgtcaggtgtcaggtccgagggatggggcttttctgccatgcacacagagagcttcatccctagcccaggccaggataaatgtggccaccactctacccctggagagggagccattcctgtgccctcagtaggccaggcagcaagaagggccctgcccatcctgtgtgcagccctcagcagagcagcccagggctgcctggaagtctgggggcacgttcctctcaggccagctgggtctggagagagatgtctggctgaagggtggcagctgcaggagcaagtgtgcaggagggaagggcgtgtgctaggcagagcagagggctgtggctgacttgggccgacagatgcccctcggctcccctgagacgtggcaccctaggtcaggcctcaggagagctcagtggagggcccgggggagggttgcacagtcagctgggagaagagggccaggtccctaccatgagggcagccctactaagctacccaaagcttgcctgctcacctgccaatgggcagagaaatattttttaaagggctcagggggtcctcctggcctggctgctctgctgagggctgcacacaggatgggcagggcccttcttgctgcctggccagctgagggaataggaatggctccctctccaggggtagagtggtggccacatttatcctggccttggcagggaccccagcagtgtgcaaaggctggctggcgtgccacagggaggggagtgctgagcacacaccttctggccctgggtcccattgatgggtggaaggggaggatagaaggctgacaggtgagaagtccttggaactgcctgagggccagggagggaagccctgccccacaaggctggattgtctgcaagcctggcttagagctccctggggagtcaataaagcgcagagtccagcccagctctgcactgccgtagggacctgtatagaggatgacaaaccctccccctgcaaccttcagcaggcatcttctgattcatcttcctggcttgcctgggaccagaaatgggacctccatttctgattgagtgcacgaatgcccaaggccacaggaccacagaatgagtcgaaaccaggaggacaatcctagcagatgctctagttaataggatggtggttttcagatggttttagatttaagctgcagaccctgttctagaaatagactcatacactgaagcccaaaacatgaaacagataaagacagagctgctgtgtctaaggaggggaagttccaggacccttgtccctgcccaactgccctccgctgccctgggctgcctgctgccttgctccccgggcctcctgcctggacactgagtcccgtatgtgaatttgcctttcacatttttcctggtggtaaaaaacagggacttcactggcagagagagcaggagctatttgcagagtcgctgacttgcaaggccccatttcactccccaactcagaggccaacaaagacagatgaggccaattggggggatttgcaccactttacaagatcctccttctgccctgagggtggattagcacgtggtgggcctggagcagctgctgaccacatctggccccaactccaaagtggcctgggcagctagatccggactgtggaacccgatctgacctaccagcaccctgggagggaaaaaggaagcaaaagggcttgttccaacccagaagggtgcagaaatcagaaaagcaggaaggccccttggaaaaaggactagccctctgtgtgagttcaggaaactctgtagaaccagctggagccttcctcaaaccctggtgctggagagacctccgagatcctctgcacctcaggtcacactgagaagctaagtgagacagggacttcctactcgaaatgggaatccctgcattatccattgcacatggccatctaactccagctcgaatacctccagtttcagaaagctcattgcctgccctatctgatccacgggtggacagcagtagatgccagaaagctcttttccctaccaaataacacgcctcatttagtgcactgaaaaagtctgccaccgccctgccagtcctaactcctatagtaccctcctaggcctggaaaaatccagaggggccctgtgccctagagactgtcaggcagtctgaggattcagcgttggcaaaacacagagatagatccaaaaagtcctcagccaggagcttgatgcgtaccccgtgatgccaggctgtgcccctctgcagccatcagcaggggtttccttgggggctccttccacaggcatggatgggtgggggcctcgtgtctgcagagtggggctgaagagctaggtatgggtcgaggaaaatgggagcagatgaagaggggcacaaaggcatccaggcaccaccccctgcccccaaaaaaggaaaagggtggcatgagaagggtgacagatggggaggagaaggggaaaaggagaggaggcacgtaggggaggagggaggtgtgccagccccttcggcctcacacccacggcaggagggccctggcctgctcagctcagccttggccctgctgctgaaattccagctctgtgtgcagctcagctggctcagtgccagtcatgtgccagctccaggctgggcagcgggaagtggggcacgcggcaggcatatggacgagaagccaggaagtgcagagcaaagggctggatgtccgcttggcccagggatgcaagtgctggcagaaccagctcagccctgccctccccacagcatggaggccgcagacccctgccttcctaaaccgcccaaagagtgcctgtggacgaggcttgatgctggacaccgaaggggccagggaaaccacatgatccagctggctccagcccatccgcctggacaacagcaagtcatagggcttactagctgaccacaggagggttgcagagaggcaggatgtgtggtggtcagggcacaggctctggggtgggtggcctggctctgaatgtcagctgactgacctcaggcaggttatgtgtttctctgagtctcagttttctcatcttaaaatggaggtaacaacagcacctgcttcatgcatgcaaccttcatacatgtgtaggaagtgctggtgtagagcacatgctgactgctcagcacaatggtgaattttatttatttctttttgagacagggtcttgctctgtcacccaggctggagtgcagtagtacaatcatagctcactgcagcctcaagcaatcctcctgcctcagcctcccaatcagctaggactacaggcacacaccactaggcctgaattttttaatatattttttatttttatttttggagacagagtctcactctgtcaccctggctgaagtgcagtggcatgatcccagctcactgcaacctctgtttcctgggctcaagtgattctcatgcctcagcctcccaagtagctgggattataggcatgcgccaccatgcccagctaatttttgtatttttaatagaggtagggttttgccatgttggccaggctggtctcacactcctggcttcaagtgatctgcctgtctcggcctcccaaagtgctgggattacaagcatgagccaccacgcctggccccaatttttttttttaagagaaggggtcttgctatggtgcccaggttggtcttgaacttccagctcaaacaatcctcccatctcaaccttccaaagcgctgggattataggtgtcaaccaccatgccccacccacaatggtaaatttaatgctgagaaaatgtggtcttgtcagtgccaaggggcccatgtgggccccagcctgggtgcctcttccttcttctatgatcctctggtggaaataccctcagaactcccttcccacaagtcacttcccaaagcacacagaccgagaagcaggaggggcggggagaccatcaccatctcctgccttcctgggcagacaccttgcctctctgaggctcttggcacatgggtccatccttaaaatccatttagggcaaaagccattttctgaggacaaggactaaccggatggttgcattaaaaaaaaaaaaaaaaagatgggccataaggggaaattatagactttacagccacctccacggtagtccaaagctatttatacaaagaacttggggtgggaagtttcacatctgccttgggtggggaagcccagccacagaagggcatatctctagaagctccagagaaagtcggcatggaggacactggctgactgcaactcagctgccgtctgaccttggacaagtgacccaattctctgggtcccagtttccttaactgtgaaatgggtcctcagtgcctcggtcacaggactgcatcaaggcttgaatgagcatgaagggcttggctttactggcttccctgggcactggacaaatggttcagagctatgtatgagctgtggataggcccacatgtgggtcagcaggagatggatcagaacacaggcaggcccctctgcagggtgaggaggggcctctggtctggccagtcccatctatttccacctccctggcatttgtgatgcttcctgcccctaggttgccttttttgcccttatgcctccccaaagcgtagaatgccagtacaggtgtcaccttctccacacagtcccccgggctcatctgtgtctggcggtgcctgtgctaaatgcccctgagcctgggttcttgctctctcaaagcgagccttggagacatttctgcttctcatgtatcttgtttttgctctcagcctccccaccccaaatccaattgtgatctcctggagggtggggagcaggtccttcgacttcccctggggaactcccagtcctgacttcacaggatgagctcacacataggaagagctcaggacaggcctggcatgcagtaaatgccatgccatgaaggcatttgctcctctgattattatctgtccccagcaccccagccccagaacaggctgcaaggggctgggggtggtgtcgggtgggagcaagtgaagcagaaacggggaagaggagggcgcctcctgccctcatccctctccttccctccctctcacccccttcaacctgcttttcctttgtgctcagaccacagattccctcccctcgccctgtgagccatctctggctgccgtgcccttgccctgtgcccccctagatccccaaaggccgtttcatcacgcctcagctccctgccccgccccccaagcccaacatgtgcggagcccgtggcctcctgccaaggcctggggctgccagtggaggcaaagagacagaaatctcaccgctcggtaggttttcttctgcccagcgtgcttgggggctttgcctggctccgctgagctctccacatgcatcgagtagatgatgtcaaagaaatcttccaccacagcgacccgcttcagagagatgccctctggctccgacaggccatctgccccctgcgacagggtggacaagctgtgttagtgtcaggaatgatggcggggtgagaactgggccctgaggccggggcaaggggtcaggacgggcaatgcctccgacagtgggtcttggggtggggaggggagggagcctaccgagggggctccctggagggggacgccagagtcagggtggctgcagctatgaaatctaccagcaacaatgggcagagaacggcgacaacgaaaatacaaattaaaaaaccaagaggctccatgttcacaatttcagacagattgtgccagactcgggcggggagctcttgaatcacacgctgtgccaagaccatcctggaagtctctggggaggggggagtgctaaatagatgcggccccatcaggagctcgccaattagcagtaacctttcactgtgggcctgggctggggtcccgggggaacagctccgatcacctgggtgactcctgcctccgccctggcctttctgaaaagcttttcgcggctgcctgccctccccactccagcagctgagcgccagcaacggcacccgggccctttgtgtgtggagatgtacagaataacaggcacgaggccacgaggaggtggcagggccgtgtgaacggggcggccgtgggccccgagcctcttatcaggctggctgagtggtgtcagctggcccgactaggtgtgccaggagcaagacgggtccttcaatagcaaacagctgtggggctgacgcctgccctcccctccagcaggaaagggggctgcagggaaaccacagggcaggaggctgggggtgaggccagggcccggaagggaacggactgctggggaactgctccgtgcaggcagtcctcacaagggagatacacagacccagagacactaggctgtcagccaccagctccttcaggggagtctgtggggacgttagggggctttgaagatcaagagcaagccatatggagggaatttgaggggaaaggaagcaggcttttctctaaaagtgcccaaaagacacatctccaagagaattcttccccaaaggaccccaactcaaggatgtcagcaacaagaggatgtgggcttcgcctgctccttctcagctctctccagcacttacaacagtgcctgacacatagtaggtagtcagtaaataatgactgaatgactgagtggtcataagtggcagctgggcagggtcacttggacacactctgccatggtttgaatacggccccatcatggaagtggccctgtgaccccgagcacttactgtgcttcgagcttcaggccctttatctgtaaaatggggataacagaagcccctttcccatgaagaactgagttgtgtgtgcagcacttggcactgagcctggagtacagggattgctagatattgttattaagaagtgctttgcagttcaccatgtttcccccaggtatgagagagccgaacaccggggcaaccctcggaggttgttagggtcaggacctgcctgaggtacagtggctggtggatggcacagatggcttcagaccttggactctgtagtccaagtagaatacaggccacactgggaggtgacgctcgctcacaacacgttctggcacagacaggtcttggtttcacccagtagctttctcgacacaccatgatggccgaacagcagtgtctcttcaccagcagcccattcaagagcagagagcagatggggggcaaagggcatctgggatgtggggtcccgagccccacagctagcgggcagtgtccctaagtggtaaccctgggaggtgacctcactggccccaacaaggccctcttgccagtggcttccttcctggtcagaacccatttcagtgggacgtctcagatagcacatatctctctctctctgtgtgtacaggagaagccacttgctggtccagcttcctcgctgtgagattatgggcaaacccttcaacctccccgagcttcatttatgagatgagctgtaaagttccatgacttttctgctcttaacctctctcaggaatcaattttacctcttttggggagtatcccaccccctccgacatctcaggccatctgtacgggctgatcaatgactaacttgttcactattgacccgtaaatgcccagcattacagggctcttcatatactgccatgacagggttgggatgggacaaatattatgataggtcagttagacttttaaaaaattttttactcagcaaagatatggatttgggatgtacagttataatacacttctaaccagaggttcacattggtgaaaataaacaaaatgaaccttaagaatgaatatagctggttttggctgggcgcggtggctcacgcctgtaatcccagcactttgggaggccaaggcgggtggatcatgaggtcaggagatcgagaccatcctggctaacatggtgaaaccctgtctctactaaaaatacaaaaaattagccgggcatggtggcgggagcctgtagtcccggctactcgggaggctgaggcagaagaatggtgtgaacccgggaggcagagcttgcagtgagccgagatcgcgccaccgcactccagcctgggcaacagagcgagattccatctcaaaaaaaaaaaaatgaatatagctgggtttctatttgttgatctgggcagtagttatagaagtgtgttcaatttattaagtcattaaatcttaacacttggccgggaatggtggctcatgactgtaatcccaacactttgggaggcccaggcagccagatcacctgaggtcgggagtttgagaccagcctgaccaacatggagaaaccccgtctctactaaaaatagaaaattagctgggtgtggtggtgcatgcctgtaatcccagctcctcaggaggctgaggcaggagaatcacttgaatccaggagacagaggttgcagtgagctgagatcacgccattgcactctagcctgggcaacaagagtgaaactccatctcaaaaaaaaaacaaaaacaaaaaccttaacatttataatctgtgtatttctgtatgtctgataaactttaatttaaaaaacagtttttaaaaaggatatcatgggggtagttccactgaatttttaaattcaggtaaaatacccatgcagaatgtaccatctttaccatttttaagtatagagtgaagtcagccacatttggatcacctgaatccagaggcatagctctagaggcttagctgcttaaaggccaatagacctccctgttcaaaattgtttcagaccagaacacagatatttctggaaaaggaaggagataaaattttgtgggaaggaatggagaaagaaagcaatctgatgaggagacaatattttatgtaggtgagatggaaatttccccctaaccagcttgtgggggccttaggtgggttactttatttctataccttttttttttttcttttttttgaaacacagtctcactctgccatcaggctggagtgctcactgcaacctctggctcctgggttcaaacgattctcctgcctcggcctcccaagtaactgggattaaaggcgcctgccaccacacctggctaatttttgtatttttaggagagatggcgtttcaccatgttggccaggctgatctgaaactcctgacctcaggtgatccatccacctcagcctcccaaagtgctgggattacatgtgtgagccactgtgcccggcctatttttatacctcttgaaagtcagtttccgcacctataaaatgggcctaaaaagtgctagttggatgttccaaggatcaagaatgtatgtcaggcatccagcacatacagacttggttaatgttcatctcttcccttggacccctctgagtctggacattttgtgtttaggaatctcctcttatctctggtccctctgacgcgtccagaggggacccatgacaaaatgtgtccccctcagtaacacccaccatcagaagagatgcacagtcttatttaattcctaaataatatgctaaggctcccacaaacttggaataagctttccaaaagtcaaagtgtaattgaccaacccagataaaaaagcaaaacgtactgtcccatgtggcctgtctcttcccagcctcccacctgccctcttaggttgactctggtaaacaacagctttgcacctggtccaatgtgaccataaaattaatcccagcaaaattattcagggaagcagttttcagttagttccttctttaaaaattgatcactttctcccttaatgttcaaatttgggtcctgtaatccacctatctctacagcaaagatttacataggaaaggagagggcctggagcgaccagaactcaaaccacgcaagggctgcagagccataccttgaactgtcctctggtgagctagggccacctggattccatgtgtgctacaccctaggggaagaacgccaggatgtctacgtggccttcaaggagaaccctgagaagacagcaacaaagggatccgacagtagtcacgtgccgcagacatctctgctatcccttgcatccatggaggtaataaccttcatgctaaatgctgcaggggaggcaggccttccctagctaaggatccagacagtgctgcaagggaagagctgctaataaaggaagcagaaagcaccttccctgtagacttgggaagcccctgccatcccccttctgcctggtacccaaattagcttcatctaatccattgccctaagcaaactggacagtgaattgacaaaggaagttcactttatctataggctggatcaagaagggacttggagtctcctgcctatcccagcttcctggaaacacctagcaggagtaatggaatggaaccctgtatcaccccatgggaagaaccacgaaaaacacacagtcacttgtgtaggatcaacctctggggccttcctgcatggagaagaacattgccatggtaacacacaccatcctttcgaaccatccaacccccaaacagcctgccagagccaggccaacagaatcagacatggcaatagttttaaaaatttatggagaagctgggcatggtggcgcatgcctgtagtctcagctactcaggatgctgagatgggaagaccacttgagcccaggggtttgagtctagcctgggcaacacagcaagacccatctctaaaacaaaaacaaaaacaaaaaaaacctacacatttatggagctacattcttggacatcaccagctcccttaacaccagcccatttgggttctaaatgaaaagctaggtggcaagtcattgacaaaatcaccaaatgtctacttaaatacatctgatatttcaaaatattacagcaatggtccttagaccagcagcattggcatcacctgggaacttgttagaaatgcacattttcaggttccaccttaaacctaccaaatctgatgtgctgggggttttaacaggcccccccagatgattctgatgcaagacagattttgagaactgctgatcagaatgtctccatgattgagccagggaggtaactgtaggaaaacaggtattggctcattaaatatagacatgctctgtgcttcctggcctaatatattaatattttcatttccgatgaaggccaattttcctaatggtgagaacaaaagaatcttattgggcaacattagtataaattcaacacatctgcccagagacttaatgtggattatggatagaaagagcaggaacgccctgcatcctgacatcagatttttaagtcctccctggcaaagttaataaatacttaagcagggcatcccttggcaggtcctttctggcttcctcgttttcctcagatggatctgaatgctcagcatgctaattcccaggctgcagacctaagagggggatcggcatgtcttaccaggccattagacaggctcctgccggggcgacctcagggagctcctgaatcggactgaatcttgcctgtctccccacatgagccaattaaatggacccctgcccctgatggtgaagtgaggtccagttgctaatggattgcagttctgtcatctccattagagcttcgaagtcacttgctggtaataagttacatacttatcaaggtgggatcacagttttaggccaccagggtgccatttagtgtgccaccatcactatattagtagagtgtgccttccagcaacgacgaggccatggttgagaggatgcggctaaatagcggagacatttctcaactgggtttctccgatggtagaagaaaaaaccacagagaaaggccttaggataggccttctggtgcatttcggatccagctcttgacaaggaataaaaatcaacgagattgctattggacgagaaagtcagccagtagagcccaccccaaaggaagcaaatctttggctaccacgtgggagggagcccaggacttcagggggctgattgcacaggcaaatgtgaggatgccgctccatcccatccaggccatcaaagtggctgagatcacagacaaaaattaccctgcatattaattactagcatgctcttcccaacttctgcaatcatgccattcctcctgtccccaaaacccagccttaataaattcagtcagggctgggtgcaatggctcacgcctctaatcccagcactttgggagacagaggtgggaggatcgcttgagctcaggagttcaagaccagcctgggcaatacggtgacccccactccccccaccccccgccgccaggaggtctctacagaaaatgcaaaaaacctagctgggcgtggcggcattcgactgtagtcccaggtactcaggaagctgaggtgggaggatcacttgagcctggggaggtgtaggctgcagtgagtcatgaccgtaccactaaactccagcctgggtgacacagtgagaccccatctcaaaaaaaaaaaaaaaaaagtcagccagaactggagttttagaagcttctggggggattcctgtaaagtctcatttcagctcctggtggggctgaaaaaagaagcaagggggaggagtcagtctcctgcaaaggggccccacagggaaaggaaggaggaggtggagaggaaattgaaaaccacactaaactaagagaacaaaaagaaaagaaaaccagaatgaagaccatcacccaaacacccagaaaccctctcttcagcatccccaagagaagctgtcataatttgtaaagggcaatcaggtgattgaagagagggtattgcttcactgggacaaaggcagtattttaatttctctcggttctgaatactacctactggggactggaaattgaaaaaaaaaaaaaaaccctccaaaataggaatttaccccagaattttaggacccaaagttccattgagcttcgtaggcctggatggggcagagggatgggaccacactctccccataaataaataaatacataaacaaggcgctgaggactcaatatagcacctgcctcttctccacccttgtgcacaatctccaactgttagcgcgtagctgccgccgccaccgccaccaccgagtcgcacctgccatctggaacaggcctcacatattccaagacctcctttctgcttcgctgaacctccatcttctttcaaatcacgctggggaccaaaacgcacaccccaggccacagagaaaggtgcctgggaccagcccctcaaacaacggcgctacatttgaggatgtcatctcctccaagcagctctgagtcttttttctctttcttttgggttttgttaactctgggatgtctggaatgggtgtagggggaaggaatgggaagagaaaggggcacagtgggccacagtgccccccagttagaaggagaggggctggggaaatgcagatccgaatgacaatgacttatgagggctggagggaggagtactgtccagcatccccggacggacaggccagggtctgggcctggctgcaggactctggcctggcgggggcagggagagggtccacaggagggtgctgtagaggtgaagtcacaggcctaaggacaacccagcccccaccccaggcaaggggctgtcctgcctgggcctcagtttccccctgtgtgagcagacaccataggcataatggctttcgccacctcataggaagtgtgtgggaacccaaatgatgcacaaacagcacccgccctagaagacacccattaaagagctctgtctgctactctggcgacccgcctcccggggcaccgcagcctaggacagggaatcgggagtcaccgaagggggggtcctaggcggaaggaggtagccctgagccagccaggccccgcgggcgggtccctctcgggccgaggaggcgccctgggcgcgctaacgagcggagagccccaggtgcgggccccacccagggccgggggaagaggtggggctggagggggaggggagtgggccgcgctaatgactgttgacagcgcgcgctggggccgagctggccgcgcgcgccgctgacagctgctcgggcggggggcaggggcgggggcgaggcggccgcgctctcttcacggcgcaggcgcgtgcgccccggcggggaggggcgggaaggcgcgcgcgcgccgggctgggttcggagggcctgctggagcggctcgcgcgggctcctcgcgggcaggcaggtaatgagagtaaccatggcaacccaccagaggaagtgtattctgcaggagacgttaatcccctctccccggagctgggacagcctgactttccattctcacacagtaattagataccagctgtcagtgcaggggggacggctccgcggctgcagcccggctgggagtgggggggggggggcgcaccaacggggcgggggggggacacgcaggaacgggggcgttaaagacacagggacgctcggctgcggcgggccagggcggctggcctccccctgtctccagcctctaggcgcgcgcccgctcacctggagaccgcgcccgcgcgggccccgcccaccccacgcgcacctgctgcgcgcgcgcccgccggcctcgcgtcccccttccggccccgccaaccggctcccggcgcacctgccctgccccgcccccccgggacgctgcccacctgtcctttgtgcagggcggtaccattcgatcttgccagctctccttcagggagcgcccgctatgtgccaggcgccgtgccaagcctgatctcccgtagtcctcacagaccctccgcggtcagtgcctctgctgctccccgcccaaggcgcagcggggtgtggccatttgcccagggtcacgcagacttgaaccccccatccccgtgcccatttaacaaccaagatactgcgcctcccaccgcgtccacatccacatctgctgtggctccggggcctcctaaccgtcctgggagacaaaacagtcacactggtggctggcgtcgcggtgcacctactgtgtgccaagcactcacggcctcgtttcactttcgcaacagcaacgagagatctgttgtcccagggtgaggaagcaaaggcacagaagagctgaagcgatttgcccacagtcacaaggtacagagtgacagagctggggttcaaatccagggagtcagaccccaggataccaactactgggctccattagtcccacccctggattcgtggtggctgaaatccagcacacacctcttcttcctttcctcagttcagcccacgcaggttctgtcccagcatcgtgagtagctgcctctcctagccatacctgagaaatcgaagaagtttctaggcctaaagccactgccacaacccgcgtttctttttttttttttttggagacggaatcttgctctgtagcccaggagggagtgcaatggcaccatctcggctcactgcaacctccggctcctgggttcaagcgattctcctgctacagcctcccgagtagctgggattacagacacacaccaccatgcctggctaatttttgcagttttaatagagacagggtttccctatgttggccaggctggtctcgaactcctggcctcaagtgatcccactgcctcggcctccaaaagtgctgggatgacaggcatgagccaccacacccagcccacaaccctcatttctgtcaggcctcccaaaagctcctactgtcagtgcaggcagctgcttggaagtcattctaggccaccccttccatttcccaggtaggtgaaccaagaccattcaggtgcgaggctggcctgagtcagagatggcctgggagagcctttggggggcagggagggttcagtcccctcaggcctggctgtgtcccctgccccccacccacaatcaggcccagggttggggggtgcacaccaaggaggggcaggaagtgtccaagaagcagaaccggctctgtgtccccagtggcggcgggtgtctggggcaggaggaggctatctgatcccttccccactgccccggccatgacctcctccctccctccctcgctccctccctccctccctccctccctccctccctccctcctccttcatggctggggtagccagcaccctgggctgcagctgagaacccagcgttccccaaccccgccagcattccagtgagaggaggggtggggggagactgcacccagagctttagggacaggggcacccctggggctgctccactctgggagggccaaggccaggctgcctccaacctcaccgtttcctgcctccgctctccccatctctcagtagcagagctgcctaaatttggctccaggagggaatgggggaggcagcggcaggcgggtgccgtcagaggccagggcgtcgctcccgtctagccggctggcatttttgctgtctggaggagggcaggggggcccggcagccctctcccggaaagggagatgttcgtaccttctgacatacactgagtaatgtgcaaacgacatgcaaaccgagcttcaaatcagcatctcagccagggaacagcttgagagctgcttttgggatgagagcagaaggaccagagcccagtgcccaggggctccagtgggggtggggtggggtggggggcggcacagagtgtctagggctgggcgttgggagactcagtttcttgccagctgcagggctttgttccagtggctggaccctctgggtcccagcccaagggcagggccatggctttctctgcctgctccagcaaagcactgggcacaccctgtcacgtggttaagcacgtgagttctgcagccatcctgcctaggtttgaaccctggctctccatgggccagctgagtgaattcctcaatcgagcacccaggcaagcagctagtggaactgggtgtctgttttagaacagccacttcccttccctggaagttgggcacgggggcatgacgtgagagaacctgggctttggaatcagaactggattccaggcctcactcagccagtgaggctctctgagtctcactcccctcatttgggaaatgggttcaggatctcaaggtcagctgtgacgtccacgtgatgaccttgcacatggtgggcacacacaggccttcccatggtgcagcctcactgctgtctgcattcatgtgactcctagctccatcctgtcccatcgctcctcttctctttgttcttctgtcctggctttttcgtctctagatgtaaatttcttgcggtctttttcccttctgtctctcttcttaactggtgatcttggaaaagtcattgcctctcagagtctcagtctgcatatcttctaaatgggagtaaatgagaggtggacaatgagctctgtctggggcctgaggctcatctttacaagaccgcccacccatcattccaaagggccaccaggggtaggctgtgccctcaactctatcgggcatggtgtgttgggggctccacttctcagtaactctgtttaaccccagataactgctctcctgcccctcggccggggctgatatgagctgaatccagcttcctgccacccaaaagccacttcctgccaagctgataccagaagaacttgttttctgtgcacagagcagtctctggtggggcagccaccagcttgcctcgggtgtgaacatttttttccatttgccggtctgtctgctgggctgggcaggggaggctggggactctgaccccttcgcctctgcacgtgcctgtcctgccctgaggtagcctctgggcccaccagccatcccaggaagggtgccaagtgtcctctgggcccagacagatgtgtgtaggccgtgacacacagtctgacacagccacacacacacagtcagtctgacagagccactgtggccactgggcatttgggcaaggactcagggagacaatgtgtgactgtcacacacagttaaggtcacagagacatggacatagcctcacacatgcaaccatctgcagtccttggacagtctcacacacaattacacgcaggcccacagccatgctcagaatcccacagcactccacacagcttcacacatgtacacgggaatcttcctccccggcccccacacctgcccagcaccgaccttccagatgcattcactgattcaacaaatcctttttgagggtcttctctgtggaggccctgggctaacccataatcagaatgactggaacaggaacaaataattagctgccctgtgctgttgcctccgtttccccatctgtgagatggggatcctagccctgccacatgggactgtcaatgttaggagtgaatgtgtggaaagccctcggtccgtgtttggcccacagtgtcatctaagtaaggctatcctggttagccaaaagcatcccatgcccagctccacgcagaacacctggcacacattatctccctgagcccttgtccaagtccccagcagctggggtcatcgcccccattcctcagatgaggaaaccgaggctcagagaagaggcccacagtctgtaggttgccccaccgatctcatgtcatgccacagtgctgctccagcctgcctcgccaccccctacacacacacacacacacacacacacacacacacacacactattccctctggctagaaggcccttctcacttgcatatagcatgcccagctcctctgagctgcctacttacacttctgtgaaatggggatactagcccgtgtcagcccctgtttattttccccagggcactggactttaagggccaagagtgaagaccattttgtcctgttctctggcacacagtaggcactcgacaactatttcaaaactaaaggaataagcaagtggcctcatggctactgaggacagagtctggaactgaatgcagggcactctgaagctggagctcacttctacattattgcctttctcatgctactagcaggcactgaatgtgtcagtgagtgaatgaatgaaaccaagatctcaggatcccagtcaagtgctccctgagtttcatttcctggtagtgtggacatgagccaagctccagccaccttggatggtggtgggggtggcggggctgatgggccgcctgaagccggctgtcaggagctcgtctggccacagccgccagcaggagagaccagctggcggtgcagggtccatcggcccgggcctggaatctgagctgccctcagaggcccagcttctctctgggcccccacaaactggcctttgttcctgggccggccaagacccagcagcttgggctttctgtctgcccgcggcacccgcgctgagctggcggggtaaatgggccagcctcccctctgtccatgcccaggacgtcgctttaggactaaatggagatgtaattttctatacaaatccatgacaatttagatggagtgattgtaattggcttttcaatgggggttttgtccagagctggtggctagaactgggtggcctgtttgaggcaggctccatttaaatgacaataaagcaataatattgaggacttgtacagtgcccagcactcctcccagcccaagtagagcctcatgtttatggatctggtccttccctgaggctgtctggacaggcgggtggtggggggcgctaagcccaggagacaggtggccatatctttgggcttcaggacacagagcttcagaatggctggggcaaggtcccgcatccactggcttacctgtgtccttattcctgaaactgtcactaactagtgcctcctcgggctagctgctagtccaggtttcgggggcaccaagacaatgagagctgctcaggcaggtcagagggagaaggctacaatggccagtacagcatgacatttgagagcatgaccaagagatgaccaacagccagacagcctgagctcaaatcctactccacttctttttaaaaaaattttttttgagacagggtctcgctgtgtcacccagactggagtatagtggcaggatcacggctcactgcagcctcgacctccaaggcttaagcaatcctcccacctcagcctcccaagtaactggaccataggcatgtgtcactacacctggctaatctttttatttttttgcagagacagagtctcattgtgttgcccacgctggtctcgaactactgggctcaagagatcctcccgcctcagcctctgaaagtgctgggattacaggtgtgagccactgtgctcagcccctactctacttctgactcgtctcttgaaccttaccaagttacttaacctctccatgcctcagtttccccagccataacatgaagctgcagtgaaagtttttgtgaagatgaaacaccttaatagtgcctggcatgtggaaggtgctatatataagtcattgccgtgattcattccaagctctagctctggtgtcagggtgaccttgggcacgtgacttaacctctttaaacctccactggctcctctttaaagtggggcttttaggagaaccgacctcacggggttgtgaggattttagaggatgcaggaaagcgctgagcacacagccgttctcgataaacacgagctctcttgctgtggtgctcttgccttgaggagctcgccagctagtgatcattaccatgtcgagtgtggggaaaagggaaaagaataaagctcgcgggaagccaccacggagctcagctggctctgccatcaggggatgcaataggagagaatgatccagagggccctcaggaacagggcaaggagtggggctgcgtgaaggaaggcttcacagaggaggtgacatttgggctgggtcttgaaggatgcgtggcacttctgccaccagaaagggtgatacccagcctggccaacatggtgaaaccccgtgtctactaaaaatgcaaaaattagctggggctgggcacggtggctcatgcctgtaatcccagtactttgggaggcccaggtgggtggatcactgaagtcaggagttcgagaccagcctgaccaatatggtgaaaccctgtctctactaaaaatacaaaaattagctgggtgtggttgtgggcacctgtaatctcagcaactagggaggctgaggcaggagaatcgcttgaacccaggaggaggaggttgcagcgagctgagatcgtgccattgcactctagcctgaatgacagagcgagactctgtcacaaaaaaaaaaagaaaaaaaagattaactgggtgtggtggtgcacacctgtagtcccagcttcttgggaggctgaggcacaataaccacttgaacccaggaggtggaggttgcagtgagccgagatctcgccacggcactccagcctggatgacagagggagaccttgtctcagaaaaaaacaaaaaaaaaaagataccagggtcaggcactgtggttacaaagtcaacaggcagacctggctgcctcctgaatgagtgatttgtgcctgtgaaaagggtggtggacagggagcctctgctgaaggtgcgatgttaagtcacctctgaaggccaacagcctgtgcaaaggtcttcaggcaggcaggcggccggcatcgtgggcagtggtgtgtaggatggtggggaggctatgctgaacgtgctggagggacggatggggtggcggctgtattcacgtgaaacaggcagccatagagggattttaagcaggcgggtgacaccatccagaggatatttttaaatgatccctctgactgctcgtggaaaatgggctatggagaagaaggggtgagagagaggcagggaagccatggggaggcagttggatcactgggggagagaagtggttagacccaaggtatagcagggcccaggagctgctggaaggatgatgggaaggcagggggcgggtggagaaaggaagggggaaggggtacaaagaggcatggggcctttgaggcgtggtgaggggctgtgtgcagctggtacctgagcagggttggtggaaggagatagcagaagagaggtgagggccacctcccacctccctgcgccaggctaaggctctccagctttgtcctgaaggcagtggggtgccaacaaggatttttctccaggcaggaaaagaccatgctgagatttgtgcttttgaaggatcattttggctgcagggtaaaggggtgggaggtggcaggtgggcgaggctggaaggagagaggcagggagggagggtggtcagtggcggctcagaggcctcagcaggcatcctggccagctcccaactccaagagcaacaaaccactttctcagaggtctaaaaccagccccaggtcacacggcttgtcaatggcagagatagatcccaccccagggtgaactcaaaatccagtgcactgttcccctttgctatcaacagccttggtcactagtaaaatccatcacaaatagcttttcatcacgactctcagagaacccatactatgacacgaaaaggtgagtactattattattcctattttacagatcaggaaactgaggctaagtcacctgcctaaaagcacacagctgggaattgacagccaggttcagatctaggcagtgtgactccagacccacaccacaggtcctaagcaggaggtctcaggccaagtggggtctatggatgtatctgggggaacctacagaggtttattacaatttgagtttgttgctgatacttaaaagttggggctgggcatggtggtgcctgcctgtagtcccagctacccaggaggctgaagcaggaggattgcttgagcccaggagtttgaggctgcagtgagttataatagtgccactacactccagcctgggtgacagagcatgaccctgtctctaaagaataaaaatttttaaaaaatgggacatttcatgaaagaagaaaaacatgaactttggacaggacctcctaatgttgacaaccccaagccccagtccttgaacttcgtccaccttggggccactcacacgtgtgcgatgtcacgttgacatctccagcatgggcctctcctctgctgccggacagccgactggactgaaagcaagtgtgtgtctagggccccctggagagccagggcgacacatccatccactcatccagcaagcatttagacccccttcccccgacccgcccacagccctggccaccaccaccaaacttcctcccccagcaggcttctccatctcccttgcttaggccaaacaccctgaaggcatccttgactgctcactggttctcacagcccacatcccatccatcagcaagttctgttggctccacctttaaactatatccagaatgcagctgcattctccgctgtcccaggggctggaggtgcagggagaggcatgtgccgttattctagcgtgctgagtctcagttccattgtctgtaagaagggcgggctagagcaggatatttggattgccattattcttgtgtccagattttggagctaggaagagcctgtttacaagacacttaggttgtaattctttttttttctttcttttctttttttttttttttggagacagagtcttgctctgtcgcccaggctggaatgcagtggcatgatcttggctcactgcaacctccgcctccttggttcaggcgattctcctgcctcagcctcccagtagctgggattacaggcaggcaccaccatgcccggctaatttttgtatttttagtagagacggggtttcaccatgctggccaggctggtcttgaacacctgacctcatgacctgccggccttggcctcccaaagtgctgggattacaggcgtgagccagtgcgcccagcttttttttcctttttttggcgaggggatggagttttgctcgttactcaggctggagtgcaatggcgcgatctcagctcaccacaacctccgcctcctaggttcaagtgattctcctttctcagcctccttttacagtcatgcaccacgacgcccagctaattttgtatttttagtagagacagggtttctccatgtttttatttatttattttttgagatggagtttcattcttgttgcctaggctggaatgcaatggcatgatctcagctcacagcaacctccagctcctaggttcaagcaattctcctgcctcagcctcccaaggggattacaggcatttgccaccatccctggctaattttgtatttttagtagagacagagtttctccatgatcaggctggtctcaaactcccgaactcaggtgatccacccggctcagcctcccaaagtgctgggattacaggtgtgagccactgcgcccggcaaggctgtaattctaattcccttctggcctgggcaagacataggtgggacacaggagagagcatgggtgttggaggcaatggcagtcttgactttcaactccttgggtcaggagctccctgtgatggaggctgtcttgttcaccactgcatccccagtatctgccagagctgaccacaaagtaggtgcccaggaaacgtgtactgaaagaataagtgatgaatgagtcctcctggtcctccagagggaccttgggcattcactaactttcagaggggcttgattttcccatctgagaaacaggcaggacaatctgatgccactgccttccttctctgtaacaacaaacatttaccatgtgcttactgtgtgcctcaccctgctctaagtgctttacatatatcaactcactgactcttcactccagccccaggaggttgggacaactctcttttatgggggagaaaactgcggcccagagaagaaagtgacacacatgcccaatgtcacacagcacaaagcacctgagctagagaccagcccgggcagcctggccccagaactctcattcttttttgagagaggatcccattctgtcacccaggccagagggaagtggctcaatcatgactcactgcagcctcaaccttccacgctcaagggatcctcccacctcagcctcccaagtagctggactacaggcacaagccaccatgcccagctaatttttgtatttttttgtacagacaggttttcaccatgttgcccaggctggtcttgaactcctgggctcaagtcattctcccacctcagactcccatagttcagggattacaggcatgagccaccatgcctggctttctcattcttaaacactgtcctaggctgtccctcagtaagaaaggaggtttgggaagcctgccccaaggaagcacccaagttgcaggtggggacatgctgggcaggactgcaagctcaacaatccttctgtggctctgtactgcctgtcaaatgccatcccaaaactcatgcctggatttgaggcccctggaagcagctccagccatgtctcctcctcccagaggtcccagcacaaacctgacattccagcctccctggctgcttctcctcccatgagctctggggcaatcgtgcctctgtgcctggacacacactgtcccctctgcccacaactgggtgcccacaactgggtggtttcattcaaatgtcctctctctccccaggaatccttccctgaccttcccccaacccccaacccaacatgtctcttgccttcaatttcctgtaacactttgccaacaaggacaataatagccaatgtgtattaaacactcctgatgtaccagtaggtactattgtcaataccgttttacagatgaggaaacttaggcactgagaggagaagcaagttgcccaaagacaggtgggatggagtcaggattgaacctacatttgcctgacaaattgcaaagctagacctctaagcccctaaaccagaccacatctcactggcaggcatacaacagatgctcattcaagattccctagtaactgactgccttgggcttccacacttaattgccttttgcacacttaagtatgatctcagagattctccaggcatcacctgctgaatttgcatttttctggtagttatttcagaagtgggcggagacactctcaaggcatgggggccaaatcaaatggtgaaaaataaacaggatcagaagtcggatagatcatgtgaactgagatctctgtaaagtggggattttaattctgatcttcagggtcattacgaggggatgcacagtgccagcatacactgaatgctcaatatacagtaacctcggtcatcacacgaatggctcacgttctagacattattgccgggagtgaaaattggttccctgtctgtggagggcagtctgtatcatctccaaaagcacatgccctcagacgcagcaattcaactccttggtataaactcgcccatgcttgaaatggccatccatattcagggatgttcactgaagtcttgcgagagcagaatatcataaacaatccaaatgtccattaacaggggactggataagtaaattatggtacatccataaaattgaatactacacagctgtaaaaaagaaggagaaagttctttatgttctaacatacttatgcactgacagcatacagatttactgtttagtgggaaaaacaacctgaagaatgtaagagctaaaactataaaactcttagaagaaaacacagggataaatctttgtgaccccggattaggcaatgacttcttagatatgacaccaaaagttcaagcaacagaagaaaaattagacaaattgcacttaattaaaattaaaaacattaatgctacaatggacaccatcaagaaagcaaaaagacaactcacagactggggtaaaatatttgcaaaccatgtatctgataagggacttgtatctagaatacagaaaagattcttaaaactcaatggtaaaatgacaagtaatacaatttttttaacgggcaaggatctgaatagatatttcttcaatagagatatacaaatggccaataagcacatgaaaagatactcaacatcatcggccatcagggaaatgcaaatcaaaaccatggtgagatgtcacttcacacccactaggatggctctaatcaaaaagacagccaataacaagttctggccaggcatggtggctcatgcctgtgatcctagcactttgagaggccgaggcaggtgggcaacttgaggtcaggagttcaagaccagcctggccaacatggtgaaaccctgtctctactaaaaatacaaaaattagccgggagtgattgcccgctactgtaatcccagctactcaggaggctgaggcaggagaatcacttgaaccagggaggcagagattgcagtgagccgagatcgcgccattgcactctagcctggcgacagagcaagactcagtctcaaaaataaataaataaataaataacaagttttggcaaaaatgtagagaaattgcaaccctcatgcactgctggtgggaatgtaaaatgatgtactgatttggaaaacaggtagttcctcaaaaggttaaacatagagttaccatatgacttaccactcctacatggaagagaataaaaagcagaggtgaacacaaaaacttgtacatgactgttcatagcaacatgattcaaaatagccaaaatgtggaaacaacacaaatgtccatcaactgttgaataaataaataacatgtggtatgtccattcaatggaatattatcagcaataaaaaggaatgaagtacagtcaggtgtcaatgatgggacaggttctgagaaatgcatcattaggtgattgcatcgttgtgcgaacatcatagagtgtatctacacaatcctagatgacacagcctattattgtactgaatactgtagactattgtaacacaatgatatttgattttttgtttttttgaggcagagtctcactctgtcgcccaggctggagtgcaatggtgcgatctcagctcactgcaacctctgcctcccaggttcaagcgattctccggcctcggcctcccgagtagctgggccactgcacccggccaatatttgtatatctaaacatatctaagcatacaaaaggtacagtaaacaataatacagtattataggtcaggcgtggtggctcacgcctataatctcagaactttgggagggcgaggcgagctgatcacttgaggtcaggagttcaagaccagcctggtcaacatggtgaaacttcgtctctactaaaaatacaaaaaagtggccgggcgcagtggctcacgcctataatcccaacactttgggaggctgaggtgggcagatcatgaggtcaggagttggagaccagactgaccatcatggtgaaaccccgtctctactaaaaatacaaaaattagccaggtgtggtggcgtgtgcctgtaatcccagctactcaggaggctgaggcaggagaatcgcttgaacccaggaggcagaggttgcagtgagccaagatcatgccaccactgcactccagcctgggcgacagggtgagactccatctcaaaaaaaagaaaaaaaaatacaaaaaagttaggcgtggtggtgggtgcctgtaatcccagctactcgggaggctgagacagaagaattacttgaacacaggatgcagaggttgcagtgagaccagattgtgccactgcactctagcctgggagacagagcaagactccatctcaaaaaataataataataatacagtattataataatttaggctaggcacggtggctcatgcctgtaatctcggcactttgggaggccaaggtaggtggatcacctgcggtcacgagttcgagaccagcctggccaacatagtgaaaccccatttctactaaaaatacaaaaattagccgggcgtgatggtgggtgcctatagtcccagctactttggaggccaaggctggagaatcacttgaacccaggaggcggaggttgcagtgagccaagatcatgccactgcactccagcctggacgacagcgtgagactcggtctcaaaatcatcatcatcatcatcatcatcatcatcatcatcgtgagcatcatcctcatctcatgggaccactgtcatatatgtggtccattgttgaccaaaatgtctttaagtggtgcatgactgtactgatacatgctacaacatggatgaaccccgaaaacgtaagtaaaagaaatccattacaaaagaccacgtattgtatgattccacttataggaaatgtccagaaaaggccaatctaaagagacagaaagcacagtagtggttgtctccctacctgggggagggggtcaagaggaaatgaggagtgaggggtatggggggtttctggggatgacgcaaatgttctaaaattgattgtggcaatggttgcacatctctgaatatatgatactgaaagtcacttaactgtatttattattttttttttagggacaaggtctcactctgtttcccaggctggaatgcagtggtgtaatcataactccctgcagccttgaactcctgggctcaagtgatcctcccacctcagcctccagagtagctggggctgtgggtacacaccaccatgcccagctaattttttaaatgttttgtagagacagggtctggctatattgcacaggctggtcttgaactcctgggctcaagtgatcctcctgccttcgcctcccaaagtgctagattacaggtatgagctactatgctcagcctgaatcatattttaaatgggtgaattgtgtggcatgtgaattatatctcaaaaaaatgctattatattaaaaaaagcaacctatggaacaatgtacaacatattttgtgtaaaactagaaacaaaacccagaaatagatatgcatatgtgcatatatatgtataaaatatctctgaaaggatacccaagaaataacagtgatttcgcccggggagaggaacagggtgactggcaggcagggccagaaaggggactttttctttttaacagtctacgggtacttgattaatttttttttttttaataatgaaattctggcagtgcgcggtagctcatgcctataatcccaacactttgggaggccaaggcgggcggatgacctgaggtcaggggttcaagaccagcctagccaacatggcgaaactctgtctctactaaaagtacaacaattagccaggcatggtggtggacgcctgtaatcccagctacttgggaggctgaggcaggagaatcacttgaacctgggaggcggaggttgcagtgagccaagatcatgccactgcactccagcctgggcgacaagagagagactccgtctcaaaacaaaacaaaacaaaacaacacctttttctggctgggcacagtggctcacgcctgtaatcccagcactttgggaggccaagacgggcagattgcctgaggtcaggagttcgagaccagcctggccaacatggtgaaacccagtctctactgaaatatacaaaaattagccgggcatggtggcgcatgcctgtaatcccaactacttgggaggctgaggcaggggaatcgcttgaatctgggggcggaggctgcaggaagctaagattactcactggccctcagccagaggatgagcttggttggtggctctgagagcataggagatcccctgaggaatcctactttacagtgtgccaagcctgctcacaaccgtcctcagattcctcacacaggccctgccagaaggtttcagcaccgccccatttccaccagcaaatcctgtggcgcgcccttcaaaacaggcctagaatcggctcacttctcaccccaccatgggcaccattctggtccaggccaccagcctttctccctggttcacctggatcactgcagcagcctcctcccagcttccaccctcacccccaaccccagtctgtaacccacacagatctgtgctcacctctcaccactcacccccacacccagggctccagcccactccactggccttctcctggcgctactcaccaggcacttcctgccgcagggcctttgcacttgtccttttctcttcctggaatcctctcccaccagatccccacatggatgttctctcacctccagtgggtctctgctcccatgtctccttgggaacaggaggcctccccacacctatctcaagcagcagcccccagccctagccccattctctgctttatttttctatatatttaacatttacatttagggttcatggtctgtctccccacccccaaacatacaggctccgtggaagatgggattctgtttctttctctagcaccaagaacagatcaatgcacgttgtaggtgctcagaaatatttgtcaaaataaaactgggtcttatgaaactgtcacagaccagaggaggttaaggagacatgacagctaaatgtaacgtagtattgtggttggatcctgggacagaaaatttacattagggaaaaactagtgaaataaaaagaagtatgagttaatagtgacgtgcctggatgggttccttagtaacatcaaatgttaaccacaggggaaagtgggtaaggagtagacaggaactctctggactatctttgcaactttgtaactgtaaatctaaactgaccctacaataaaccatttgctgaaatgttaagaatgtattggatgtggccaggcgcggtggctcacacctgtaatcccagcactttgggaggccaaggcgggcggatc

SEQ ID NO: 23 - DNA, 546 bp, Homo sapiens
ttccagacaatatttttctgctgtttaattgatctcaaggaaggagaaattcaagtccacaaaaacttacatcaattctgtttatcacatacaaaactaaacatacaatataacagcaaataacaaacatgctgaatattttcaagccattttgaatggtgtcctgtacatgtacataaataatacatactgcttctgaattaccttaaaatacagtaccaccaagagttatatttctatgtaactactccataagtgagcataaaggaatgaggaagtagacgatatccatatcagataaagtagaaagtcttatgtccttctgaaaagcaacacagtaggcccaagaacaactacaaaccattttccttttagctaggaggtatatggcaagaccaatgatattctcttccccatcctttttgtcacagggtatgaagtctatcctattcaagttagttacaagtcttcagcccatttagtcatctaagaagttgagaaagtctaaacctaagtaatcacagcaaatactgcaaatactgatat

SEQ ID NO: 24 - DNA, 737 bp, Homo sapiens
ttgcagttgaaatgacctgagaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttaaaaaaaaaaaaaaaaaaaaaaaaaaaaaaaaaaataaataattaataaatataaaaattaataaatataatattatattatcaatatctattacttcgggtgaaagaataaaaattaattattttattttctttttggggcctcttcgcccaaggcacttttaatttggagaagtttatttggcggggcaaattgaggtcaatttggcaattttcccttatgggggcgattaaaaatacggggcgcggttaaaaagggggggtggg

SEQ ID NO: 25 - DNA, 582 bp, Homo sapiens
tcttcagaacctttttattcatcatctaaccaacagaggtggttggctcgaactcaaactaaaatggcctcaaaaggccacctcgttacgacatgacagggcaaaaccagaagtagggacagagtttagcctcagttctctgcagagaagaccaagcatgtatttacacacaggtgcctcattaagaactgattggcaatgttccaccagcacagacccagagtgtgcagaaatccgtgggggctctgtatatgtgtcattcagacaatccgccgattcctcagccataaacaagctcttgctttttgggaggagggtgatcagcatgttatcttgaatgatggcaccatttgtttactctggaactttgaaggggaggtgacaacttattttctcccctgaatctgagatgcagtggcctgtcagagtatctaaaaatggtggtcctggaagacaggtgggtgggtggttgcccctaacagagagtttacaggggtaattggtgttggggctctttcagtacttaatcctgctgtttttcagaaaccctttgcacctgggccccatggagcagcaggccct

SEQ ID NO: 26 - DNA, 2207 bp, Homo sapiens
ggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaatgctttgccaccaa

SEQ ID NO: 27 - DNA, 2837 bp, Homo sapiens
gtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtctttaaaaaa

SEQ ID NO: 28 - DNA, 139505 bp, Homo sapiens
tgggcctggctaaagaaaagcctgcatttccaaacaagtcccagagcagatcaagctgggagactgcccccaggaggacgaggctcctccaagcaggatctgctcaggggaatcaaaataaggtttagtgcgtccaacatcctgcgtggacagtcctccaggactcctgccgctgccaggatctgaactgaggtggcagggacacctcctgtcagaacttcggctctgctgctgggttcactcctgtggtctcacacaaaatgggccggtagcctttgggcccacagccccaacctgcctagagtaggcagccgctgagtttatgaaagaggctcctgggaaaggaatcatctcccaccctctgcagaagtttccatccccacccctatccaccaggctcctttccccacagggtcaggggtggacacttgagcaggaccagaaccaccaatccccaggggaagccttgcccatcccttggctgcaggggcagtaccctgtgtgtttcctcctggggcagggctcctgttgctgcccaggacccagtggaaaggatggtgtgacaggtgcaccagtggaccctgagacaccctctttgtcctcaggctttgaccaatgagcacagtagccaatcggagatcaaagctggataaccaggaaaatctggatctcaactgtgtgtgtgcctgggggtaggactgccagatttagcaaaacaaaaacaaatttaaaaacagggtatatctagaccgggtgcggtggctcctgcctgtaatcccagcactttgggaggccaaagcgggtgatccacctgaggtcaggagttagaggccagcctgaccaacgtggtgaaaccccatctctactaaaagtacaaaaagttagccgggcatggtggcgggcacctgtaatcccagctacttgggaggctgaggcaggagaattgcttgaacacccaggaggcagaggttgcagtgagctgagattgcaccattgcactccagcctgggcgacaagagtgagactccgtctcaaaaacaaacaaacaaacaaacagaaaaaacaggatatccagttaaatttgaatttcagataaacaattttaaaataatgtctcaagcagaagttggaacatacttatacccaaaaagtatttgtttatttgtaattccaatttaactggcatattattctgtattttatctggcaacctagaatgggggtaatagccccccaaatcgctccctttgttaattggtccctgtcttctgtcccccaacccctaaaggcagcagctgactcccccaactaggggcggggcctgttagggtcaggcagtgcctctaacccagacgctgagcaggagagcagagagggggtgcttcagcctgaaactaccccttccccagaaggctggggtcccaggcgggcctggcacctgggctcagaggctctggctggatttgccaaactccctgattgtagcatgtttgtttctggtctggggagctgttgagtacctggagctgccctcttccctggggctcctcctggcaggcggcttccgaccctgccctcaggtgggctggccctttccagggcaggagaaaagatacctctccagaaaagagggaggcgcagcctgggagtgggggctcgacccaggagcgagaaagaggaaccccagccaggcaggacccgccccagaaggtcactgctgttgctggcagccagtgaaaagaggatccagaaaaggagagggcttgtttctggtcagcaccgaagaaggaaggtgtggagaggaggggccgggccgagagcaaataccgcctttttggtgcagcagcagccctgtctctgaccccggccgtcctggggagatgaggtttaaaccagcagaccctgaagggaaacttgcaggacccacagcaagcctggtacaggcggaggaggccttgctgtccctttttggcccgtggggctgtccatcttaaatttaaggaagagggaggcggggtgcagggactcacacctgtaatcccaacactgtgggaggtggaggcggggtgcagggactcacacctgtaatcccaacactgtgggaggtggaggcgggaggatcgcttgagcccaggggttcaagaccagcctaggcagcatagtgagaccccatctcaatttaataaataaataaggaagaaagagggagacagtagctgctcaaatcatgggtgggaaagctgggcctgggagcgtttagctggtggggtcttggcgaaggcgggggacgggcagaaccttgggttcatcatctctgggaaccctttgtgcacccatcacctagcaacaggatgcagccttccctccgccctggaaggccaggtcacaaaggccatcagggcttgtccgggagccggtatcccctaagactgccctgtgcctctcgcggcgatcccggcccagcggctgggcgttagggccaccgctcatgtgcgtcatctgcttcgtgaaggcgctggtgcgcgtgttcaagatctacctgaccgccagctacacctacccattccgcggctggcccgtggccttccgctgggatgacgtgcgcgccgtgggccggagcagcagccaccgggcgctgacctgcgcggcagccgcggcgggcgtgtggttgctgcgggacgagacgctgggcggggatgcgctggggcggcctccacgtggggcgcgcagccaggcgcagtgcctcttgcagcagctccgcgagctgcccggccagctcgctagctacgcgctggcccactcgctgggccgctggctcgtgtaccccggctccgtgtccctgatgacgcgcgcgctgctgccgctgctgcagcagggccaagagcgcctcgtggagcgctaccacggccggcgcgccaagctggtggcctgtgacggcaacgagatcgacactatgttcatggaccgccgccagcacccgggcagccacgtgcacgggccgcgcctcgtcatctgctgcgaaggcaacgcgggcttctacgagatgggctgtctgtctgcaccgctcgaggccggctactccgtgctgggctggaaccaccccggcttcggcagcagcactggcgtgcccttccctcagcacgacgccaacgccatggacgtggtggtcgagtacgcactgcaccgcctgcacttcccgcccgcgcacctggtggtctacggctggtctgttggcggcttcacggccacctgggccaccatgacctacccggagctgggtgcactggtgctggacgccaccttcgacgaccttgtgccgctggcgctgaaggtcatgccccacagttggaaggggctggtggtgcgcaccgtgcgcgagcacttcaacctcaacgtggccgagcagctgtgctgctacccggggccggtgctgctgctccgacgcacgcaggatgacgtggtcagcacttcgggccgcctgcgccccctgtcacctggtgacgtggagggcaaccggggcaatgagctgctgctgcgcctgctggagcaccgctaccccgtcgtgatggcgcgagagggccgcgccgtcgtcacccgctggctgcgcgctggcagcttggcgcaggaggccgccttctatgcacgctaccgcgtggacgaggactggtgcctggcgctgctgcgctcctaccgtgcacgctgcgaagaggagctggagggcgaggaggccctggggccacacggacccgccttcccatggctggtgggccagggcctgagctcgcggcggcgccggcgcctcgcactgttcctggctcggaagcacctcaagaacgtggaggcgactcacttcagccctctggagcctgaggagtttcagttgccctggcggctgtaacctatatgccccagtgggggatcacgcacttgaactcctggccttcttggttcacctccccataccgccaaccattgcagggggccggcgccgacgcggggcggggcgggggggggcgcgcggggtgctcctgatctgctgtctgggggagggtaggcagaacacggggacttggtgctctccttccttcacaggggcgttctgaccgtcctcccattcttcctagctctgtcccctcctttctctcttcctcctacaaatacttttggctgcccccacccagctcctaagggaatgaaaggttaacctgacccggtttatggcaatactgtgtgatgggtgccttgatcaccacaaaaggatgatgggaacggggctgtggggtcccagggaggagcccttcacctggcctgggttacaggatggctcctgggaagacaatgccagctgtgcgctgaaagtctgtgcaagctgctcccgtgaaaaggaggacattggcatggcagggctgtgggcaggtcttagtggctggacattcccaggagttagcactggctatcattctgtagggctccctcccacctccaaactcctggcttctacaccagggcattcacagacagattgcagactcacatggtggcatgtgaggctacagatacacttgcacaggccagaggatactactgcgtgtcccctggagccaggcctgggctggactttgttcctggcttagggatgcaacacagaatgggacaaggcctctgctcacaatggtctgtaatgtcacatctctgtggtctgccctgaactgcctgaagcagggactattgtccctacatgtccctagtccccgggctggcctggttgggttgagcaagaatctctggaaagaatgaaaggcagcaaatggagaaaacattactgagagcacgagagcaggctaaggccgtggtggtaagggactcgggcctgtgcaagagtaccaggaagacacctgtgggaggaggtggccgggtgaaggaaggggcagtgggaggagcttccatgcctagggaccagtaccaccccaggctggaagcccagagtggagtcctaggacatcagatcctaaagggcttgaataccgtttaaggcttttcttccgggagcaagtaggagccaaagaagggaagttgcgggacttgttttcgtggggccagttgcctggtggttacgcgcctctcctctgaagtcaggcatcctgttccagagtatcctggttgcgcttcaacttgcggagtgacctggggcaagtgactttaacctcagcttcctcatctgtggagtggggagggcgcagcgctggtcgccctgaacaggaagtgagacaacctcggggtgcacacgcgcaggcccgagccgcagggtccacgcccgaggcgaggcggcagcggcgcctgcagggcgaggggacgaatcgcgatctttttcagagtaacccgcgtacaataaaaagtccccatgaaaaggacaaactagccaggcgtgaggggcggtggctcacgcctgtaatcccagcactttaggaggccgaggcgggtggatcacctaaggtcaggagttctagaccagcctggccaaggtggcgaaacccccgtctctactacaaatacgaaaattagccggacgtgttggcgcgcgcctgtaattccagctactcgggaggctgaggctggagaatcgcttgaacccggagggcagagattggagtgagctgagatcgcgccatggcactccagcctgggcaacaagagtgaaactccgtctcaaaaacaaacaaaaaaggaccaactaaaaaaagaatataaatacaataaataacaggacttacgggggcaggctgacccctaaagtaaggggtcgggctggaaaggatctcaaggggtcagagtttgagccgccgaggcgcgcgagccccagcactcctaggcagctgcatccgccccggaagatcccctggggccctgcgctggctttccacagcgccatgttggacggtcctcccacttcccaccttcccagtcctcccgctactctgaccgttctacctgtgattctcgctggtggagtcaacctggaatggattcccgccgaaccacgcctccctttcctggttcgcccgcagtttcggcctatcaggttgagtcgggtaaaccaggacgggccaagcggcactctcattggatatcactggtgggggcgggaagaaggcggagcacgtgcccgggcggaagtagccgtcgcatcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtacctgccgggcccggccccttcgccgcagatgggcccaggctgcccgttgttctccgtctcccggggtcgcgtctgcgactctctgtcctctcggtctcggttcacccaccccgcggcccctcttcagctcccggggccactgacctcgaagcttatgatggtcgtggtgtgttttttgcccgcggcccagaccgcttcctgggctctctccagccgccctcctggtctcccctgggaccgttccgaggtgtggttccctggcgcccgccgttgctcccgtagtttgggttctgtcgctcccagcaggtctcgcttatgccgcccaccccgtgccctgctcttgcttgctctgccaccccccggtccctgcgcggggccctcgggttcacgctgtctggccctggacccagtccgaggtgttgagggcggctcccgagcagagaaggggtcttcgcgttcagcagagctccccttgggcagcaactctgctcggagctcagcctgcttaggggttgcctcatggagagggggtggagtgagtcaggggcacacccagcataccaggcctgtttccagaacagtctccccagagcagtatgagatggccactgaggggcgtggagcgagcccaggagattaaaatcttgagaagatgataaaagtctgccttgcattttggggctctagagagggatgctaaatttctttctttctttctttctttctttatttttttgagacggagtcttgctctgacgccaggctggagtgcagtggcgcgatctcagctcattgcaacctcgacctcccgggttcaagcgattctgctgcctcagcctcctgagtagctgggactacaggcacgcgccaccaggcccagctaatttttgtatttttagtagaggcagggtttcaccatgttgcccaggatggtctcgatctcttgaccttgtgatccgcccgcctcagcctcccaaagtgctgggattacaggcgtgagccactgtgcccggctacatattaagctttataattcctaggtgctgcattattctggagggtgttttttgtttgtttgtttttgtttttttgagatggagtctcactctgtcgcccaggctggagcgcagtggctagatctcggctcactgcaagctccgcctcccgggttcactgccattctcctgcttcagcctcccaactagctgggactacaggcgcccgccatcatgcccggctaattttttgtatctttagtagagacggggtttcactgttagccatgacggtcttgataccctgacctcgtgatctgcttacctcggcctcccaaagtgctgggattacaggcgtgagccaccgcgcctggccttttttttttttttttttaattttttttttggggacagcgtctccctctgtctcccaggctggagtgcagtggtgcaatcatagcttactgcaatcttcaactcctgggctcaagcgatcttcctgcgtcagcctcccaggtagctgggactataagactacaggcgcaccatgccaggttaattggtctttctacttttttttttttttttgagacggattttcgctcttgttgcccacgctgcagtacaatggcgcgatcatggcttcccgcaacctctgccttctgggttcaagcgattctcctgcctcagcctcccgtgtagctggcattacaggcgtgcgccaccatgcccggctaattttgtatttttagtagagatggaggtttctccatgttggtcaagctggtctcgaacttctgacctcaggtgatctgcccgccttggcctccaaaagtgctgggattacaggtgtgagccattgtgcccagcctcatttgtctttttttaaatagaacagaaaggctgggctcggtggcttacgcctgtaattctaacacattgggaggccgaggccagtggatcacttgaggtcaggagtttgagaccagcctaaccaacgtgccaaaaccccgtctctactaaaaataaaaaaattaaccgggcatggtggtgtgctcctgtagtcccagctacttgggaggctgaggcaggagaatcgattgaacccaggaggtggaggttgcagtgagcggagatcgtgccactgcactccagcctgggtgacagagtaagactcgtctaaaaaaaaaaaaaagagaatcagtggataaaaaagtggatacgcttcgtttagtaagcgtttgtggagcgccaaggaagtgcacacggctccagtcctatgggacatttgaagggagtgagatgcagccagcttttaagaagagtatctttgttaagtgcatttaatctggtgtctttgtgttgtcttttaaaaggcatagtttttttttctttttcttttcttttgttttttttttttgagacagtctcaaaaaaaagagacggggtttcaccatattggccaggctggtcttgaactcctgacctcaggtgatccgcccgcctcagcctcccaaagtgctgggattaccggcatgagccaccccgcccgaccagtttttctttttttttttaaagaatttttttttggccgcgcgtggtggctcaacgcctgtaatctcccgggttcaagtgattctcctgcctcagcctcccaagtagctgggaactacaggcgcgtgccaccacgctaactaattttgtatttttagtagagacggggtttcaccattttggtcaagctggtctcgaactcctgacctcatgtgatccacctgcctcggcctccaaaagtgctgggattataggcatgagccactgcgcctggcagtaagcctgtttcttttcagaatgttttggtcaacagggaaagtgttacaatagtcatgtgcttggatttggagagaatcgaaatagactgtttttctttatgtgaaatcttgtagacttttagggtagtcaggaagatgcatttgacatgaagaaaaaacagtggctgcaggaatttgaatgtgatctgggtgtagttgaggtgtgtggtggcagcacaccgctctgcacctctctgcctgctggcggccttctggcagtgggatgagaatcgggaggtaagtaaagggaattttgttttgctgcctccctgaaggagctgaatgagcagcatgtgctcctagtacgtaattttagcatgtgctctgtcagatgtgttgagaggaaagtgatgcttattgtgtatattaaccatattaggttcctttttttaaaaaaagtggaaatttgtcagggtatggtggctcacacctgtaatcccaacactttgggaggccaaggcgggcggatcacccgaggtcgggaattggagaccagcctggccgacatgacgaaaccccgtctctactgaaaatacaaaaatagccagcgtggtggcgtgcgcctgtaatcccagctactcgaaggctgagacaggagaatcacttgaacccgggagacggaggttgcagtgagctgagatcgcaccattgcactccagcttgggaggcagagtgagactccatcaaaaaaaaaaggtggaaggtctgttagattgagctgctttctctgtagcaagggtttcctgcctctgacgatagtattctcactgggaagccagaattcgggtttgcctgccttgggccggcatttgtcgtgccctgaagcagcacaagtggcattggcttttcagctcaggtggtctgaggtgtggctgccctcgtctactgcccatgctgtcctcacagacctttcagagaagaggtgttagtctccagggtctcacccactcccacctgtgcttttgtcctgctagagacctctaccgtatttacttggaactaacttatttgacactttgtggcctcattttgtctctggcagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtgctgtggcttggctgtctgtcctggggtgaattggagttaaggccctcttggattagtgagaggccagggtactggccacgctcgggaggaattgccctgggtggtcacctaccctgctctgtgttccgactgataacggggttctctttgtatgtgcccagctccatgcactggactcagagccacctggcagtggagacagggcatgactcccttcccatacctctgtgcctggcccttcctaagtgctccctgaggagtgttcacacatgaaccgcctctgagcagccatctgctgggagtgtctctgttggaattaacacttgataatcatttttaagaccccatgaatctttcttgtcctggatcttaagttttcttttaaacatatttattttggctggatgcagtggctcatgcctgtaattccagcgccttaggaggacagggtggtaaggtgggaagatcacttgagcccaggagtttgagagcagcctgggcaacacagtgagaccttgtctctacccccaaaaattagccaggtgtggtggcatgtgcctgtagtcccagctactcaggaggctgaggtgagaggattgcttgaggccaggaggtcaaggcttcagtgagctgtgattgcatcctgcacagcagcctgggtgacagggcgagaccctgtctcaaaaacaaaacaaaaacttcttttctaaaaagtatttatgtgatcttctttaagtgagagtcccttaagagtaatgtaggaattaagaacaaaagcctccaaccataatttttagtcaaaccaactgccaagagttttcttttcaccctgtgatgtggtttaattccagaatctgggtccaggcctaggtctgagtaaggttggttgtgccgctgagtctgaggaccaggtttcagatcctgaggacatcacacagctatttctagcctagaagattaaaggagagtagcaggaagtccaaggacactttgctttccatttaacttcagaatatgtgagtttagaaactaaatccacaaggtttttttcagagttgaattacaataaggtgaagtttttttttttttttttttttttttgagtcggagtctctgccgcccaggctggagtgcagtggcgcaatctcggctcactgcaacctccaacacccgggttcacgccattctcctgcctcagcctcctgagtagctgggactacaggcgcccaccaccacgcccggctaatttttttgtgtttttagtcgagatggggtttgttttttttttttggagacagagtctcgccctgtcgcccaggctggagtgcaatggtgtgatctcggctcgctgcaatctccgcctcccaggttcaagcgattctcctgcctcagcctcccgaatatctgggattacaggcgcgtgcctccctgcccatctaattttcgtatttttagtagagacagagtttcaccatgttggccaggctgatctcaaactcctgatcttgtgatccacccaccttggcctcccagagtgctgggattacaggtgtgagccactgtgcccggcccctacaaggtgaagttctgtattgcttttttttgttgtttttcttgagacagagtcttgctctgtcgcccaggctagagtgcagtggcgtgatctcagctcactggagcctctgcctccctggttcaagtgattttcatgcctcagcctcccaagtaggtgggattacagacgcctgccaccacacctggctaatttttgtatttttagtagagacagagtttcaccatgttggccaggctggtcccgaactccgagtctcaagagctccacctggctcagcctcccgaagtgctaggattacaaatgcgagccgctgtacccagccaagaaagagaatttttttttttttaaggacggagtctcactctgtcgcccaggctggagtgcagtggcgtgatctgggctcactgcagcctccacctcctgagttgaagtgattctcttgcctcagcctcccgagtagctgggattacaggcgcacagcaccatgcctggctaatttttgtatttttagtagagacggagtttcaccacgttggccaggttggtctcgaactccagacctcaggtaatctgcctgcctcagcctcccatagtgctgggattacacgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtacccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagggtgtttttttctgtcacctgtgtcactgtccatctgcctcctcctctctgcatatggaattctatgagtgcagacggtgcccggctgccaacagttccagcttctattgtccaagcccagactgagagccctgagggaaaaggatcctcactgttttttgtttgtttgtttgtttttgaaacagtctcggtctgtcacctaggctggagtgcagtggcatgatctcggctcactgcaacctctgtctcctgggttcaaacagttttcctgcctcagcctcccgagtagctggggttacaggcgtgcaccaccatacctggctaatttttgtatttttagtagagacggggttttgtcatgttggccaggctggtctcaaactcctgacctcagataatctgcctgccttggcctcacaaagtgctgggattacaggcgtgagccactgtgcccggccagggtcttcaccatttttttgttgttgttgttttgttttgtttgagatggagtctcgctctgtcacccaggctggagtgcagtggcacaatcttggctcacccgcaagctctgcctcctggattcacaccattctcctgcctcagcctcccgagtagctgggactacaggtgcccgccaccgtgcctggctaattttttgtattttttagtagagacagggtttcgctgtgttaactgtgttagccaggatggtctcgatctcctgacctcgtgatccgcccgccttggcctcccagagtgctgggattacaggcatgcgccactgcgcccggccggtcttcacctttttaataccatgcccagtcctagtaaagagctcggacaaacctggcatggtcatcctgggccattcctcatgaccacaaatggacatggtgattggtagctctcccagaaccatttagttgtggggcatgggatagttccctggagtcaagttcctagtaccagataaaaacaaatgtctgctggctgggcgcggtggctcacgcctgtaatcccagcactttgggaggctgaggtgggaggatcacctgaggttgggagtttgagacgagcctgaccaacatggtgaaaccccatctctactaaaaatacaaaattagccgggcagggtggcacacgcctgtaatcccagctacttgggaggctgaggcaggagaatcacttgaatctgaaaggcagaggttgcggtgagccgaggtcgtgccattgcactccagcctgggcgacgagcgaaactccatctcaaaaaaaaaaaaaaaccaaaacccaaaaatcagatgtctgctgtagatgctgttattcctaggacgagttaatgctttggtaagcggaaagttcttgtgtaactcatggcactgtgcatgaggatgttagtcacttcctgcagtagtgatggctcatcatgtcaactgcatgctttgcaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcgtaggtacctgccccaggcgcacccctgggggctgaagagaacgggcaccacacgtgccccggcatgtgggggggcgtcgtcatgcccagggacgagttgcagccgtggagttgagtggcctgtttggaaggatccagagagaggctctgagcccttggcccagcgactgtgccttgtttgttcaaaaagcttggtgtctacatgtgttttatttatttttaagtttttgtgtactttattattattttttttgagacagagtctcactctgtcgcccaggctggagtgtagtggcgtgatcttagctcgctgcaacctctgccccccgggttcaagcgattctcctgcctcagcctcccaagtagctgggattacaggcgcctcccaccgcgcccggctgatttttttttttgtgtgtgtgtgtgtgtgtgtgtgtgtgtttttagtagagatggggtttcaccatgttggccaggctggtcttgaactcctgaccttgtgatccacccacctcagcctcccaaagtgctggccaccacgctggccttttttttttttttattattattcttttttgagatggtttcgctctgtcacccaggctggagtgcagtggcgcaatcatgattcactgcaacctcaacctcctgggttcaagcaatcctcccaactcaacccccctcgtagctgggatgacaggcgtgcgccaccatgcctggctaattttttcacgttttatagagacagggtcttgctttgctacctaggctggtctcaaatttctgggctcaagcaatcctcttgttttggcctcctaaaatgcttgggattacacgtgtgagccaccacatccggcttatatacgtgttctaaaaaggcagacacactggctagttgtcctggtggaaaatgataggaagactgtttcagggtccagacttgagagagcactgatcaggtccttggcaagagcggtttttctgtggtccttgttgtgggtgtggcatggtcacagcctctgacccagatatggccatatgggccgggcatggtggctcatgcctacaatcccagcactttgggaggctgaggcgggtgtatcacttgaggttaggagttcaagactagcctgaccaacatggagaaaccctgtctctactaaaaaataaaaaaatttagctgggcgtggtggtgcgcacctgtgatctcggctactagggaggctgaggcaggagaatctctttaacccgggaggcggaggttgcagtgagccaaaattatgccactgccctccagcctgggtgacagagcaagactctgtctcaaaaaaaaaaaatatatatatatatatatttatatataggaccatatggtcccacaaccctagggactctgaccctccccgatgacgacgtggtcctacatgacgacgtggtcctataaccctgggacacctgtcccagatgtcgctcagctctgaatttggggagtgctgctttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgacagaaaagggaacatcagttccgctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctctccgcctcctgacactcagtcggggaagggggctgtgcacacttggcacaaagcttgttttggtatttgctggctattttttcttcctataacttttcttctctcaggtaaactatcctttaaacttttgtggaacagggaatagtagctgagagaaactcactcagccacctgaccacacttaaaactcccctctgcctgatatgcgtcccttatgtaagaggcctgcactggtcctggctgtatctctaactaatagagctccttggcttccggcagtgcacaagctggacaacaccacttggcctgggtttgttggtggcgaatttttgtttgttctaaccctaacccttttccctgcttagctccagctgttgggttctcagaattcctttcctcctttaggggtagttcttgagtggagggcatggtgtaggatatgctggtggaaatttgaaatcctcacgatctgggaggcactgcattgtcagagcatcagccagtgtggatcaagtgtggatagttttgtatgtgtgtgtcagtggtgttgttcagagtgactcctaatatttggagatccttaaactagataatagcacttcatttacttgtgctctgatctgattataacgtctttaaactgaggaggggaatatttttaaatagtctctgtgggattttttcatctgttatttagaaggaagcgctgtaatcgttgccacagaacatgggcagaaagtcctcccatgttggtctgaaaggaagcagttgctgccgagcttgtcttgaaggtcctgggggaccaggctggcactgcgtgcacatggagcctttgcgtctggtgtcacggtgggaggctggtgtcaggaaccccgggcggttctcggcatgttgccccgggtattccagggacccgggtggttcgtgggcatggctacagcagccagctgtacatctgggtgctctggggacccgggcggttcacggcatgttgccctgggtattccagggacccgggcggtttgtgggcatggctacagcagccagctgtacatctgggtgctctggggacccgggtggttcatggcatgttgccctgggttttttttgtttgtttggttttttttttgagacaacgtctcgttctgtctcccaggctggagtgcagtggcgccatctgggctcactgcaagctccgcctcccgggttcacaccattctcctgcctcagcctccccagtagctgggactacaggcgcccgccaccacgcccggctaattttttctatttttagtagagacaggatttcaccatgtcagccaggatggtctcaatctcctgacctcgtgatccgcctgcctcagcctcccaaagtgctgggactacaggcgcccaccaccacgcccggctaattttttgtatttttagtagagacagggtttcatggtgttagccaggatggtttcgatctcctgacctcgtgatccgcccatctcggcctcccaaagtgctgggatgacaggcgtgacccactgcacccggcttgagcagggtgttctagggaccctggtgggctgtgtctcgggctgttgaacagtgactttgctgggcagcagatggttcctaggttgggacagtgacggtcatccttgcagtttgggcatcaggcggacgcacagtgcagactcagtctgaaaatagtcttaggagacttcagtgctgttttgtaaaaccaactgacataaagctgccgggatcctatttcaaataaatagtgttttagagagcttattacaacactcagcgtcccgacccctctggagaaacctgtggctcagcatggaagcatatggccagtgcatcacctggccgaggccattcccctgagttctgtggcgagagctgtcaactgacggttccagagtggaagcgtttctgccgggaaggcccaggccgagggcgatggtttctgccgggacggcccaggccgagggcgatggtttctggtgggaaggcccaggccgagggcgatggtttctgccgggacggccgaggccgagggcggtggtttctgccgggacggcccagacggaagggatgcggcttgggaggtggggcctgaggatgtggccatggcgcgtgctcttcctggctggtgcctctcctagtcagcttcaggagatgggctgtagatgtacctccactgcccagagctctgcaggggaaggcagtaaaagctccctgcatcctgacccacgtgtttgtagatcctttcagctattggcgccctggaggatggacgggaaggagaacgtggccggtgggtggaggatagcactggtgcctggccccatgaggctgcaatgcggccacattctcagtgggtcatgtctgaatgcgagagcagctgtgttctgcgagtggtgaaacaattgcctgttgcattctatttataggcagaggtaactaaaaacctcagtgctgagaggggcatcatatagatcctgcagttatgagctggttcacttggagttgttttggttgcaggtgacagaaagcacgactcaaggtagcatcaaccaaacagggaggtgggagcactcaccaggcagagaagtccctgcccccactgctgcagcccaacagtgtggccccatatgggtctccctggactaatggctgcggccttggaggtggtgtgctctggccaggcctggatcacttgtccatcctgagtgggagtgggggcagcccccagagacagactcaggagagggggagtgcaaggatgtcccccagatgccctgtgctgcccaggggacagctcactggcagtgggacgaaaccgctgtctgtccagggctctcttcctagaaggtcttaggaactcccaaatgggtgctggctggggttgcccggcccggtgctctcaaggagagctgaagctagttattgggtgcagatgctggctctgacccctgccccttcctcccgggctcagcttccccatctgtcatggagtaataacaacccagccttctggtccactgaggaatgtgtgtgcctgtgtgtttgacgctctcagaacaggcctgcagcgctgtgagccttggaagggggcctcacagctgctgccgccaccttggaggcccaggatgggactgagaaggggaagggagaggtcagagccacagctgttgggcagggacctgctgtaggaagagaaggccagggaggcgctggtggtggcctcaggctatgcaggtgatgcccattgtttccagggccatcccagtttggaggttcctgtttctagaggaggttcccttgtgaccccctcatttccacacccgagcaatgctgagggctgtggggcccccaggggcttgagtgtggtttatggcacagcagggactgatcacagtggcaccgggtgtcagtggccagtggtcagtggccaggaaccctcaggaccctcctccttgtgtgggtggcatttacccacccacaggtcacgctcaggacccgcatctcattccgatcctccttgtgtgggtggtacttacccacccacaggtcacgctcaggaccccacatctcattctgaaggccgggcacaggcggttgttttctctccaacttcggtttccccatccccactcttagggcacaaatgcaggtgtagcttccccatgcccactctttaggcacaaatgcaggtgtagcttccccatccccactcttagggcacaaatgcaggtgcagcttccccatccccactcttagggcacaaatgcaggtgcagcttccccatccccactctttaggcacaaatgcaggtgcagctttcccatccccactcttagggcacaaatgcaggtgcagctttcccatccccactcttagggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactctttaggcacaaatgcaggtgcagctttcccatccccactcttagggcacaaatgcaggtgcagcttccccatccccactctttaggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgctgtgagcgctttagaatcctctgctgcaggtgactttgcttcagcgaaccacagaatgttcacatggttttatgcatttgttatttcagggaaaatcaaggttaaagatgtcttcagaatttgtatttttgggctgggcacggtggctcacacctgtaatcccaacacttttggaggctgaggcaggcggatcacgaggtcaggagatcgagaccatcctggctaacacggtgaaactccgtctgtaccaaaaatacaaaaaaattagccggatgtggtggcgggcgcctgtagtcccagctactcgggaggctgaggcaggagaatggcgtgcacccgtgaggcagagcttgcagtgagccgagatggtgctgctgcactccagcctgggctacagagcaagactctgtctcaaaaaaaaaaaaaaaagaatttgtgtttttgaaactaaatatagcaggtcattagttacttataactggtgttttattaataaaagaagaaaaaatttaaaaacagccatgattccagctgcacggagcctggatgggaaagtgcatcctctgggctgagcacggtggctcacacctgtcatccgagcgggctgggcgcagtggctcacacctgtcatcccagcactgcgggaggccgaggcgggtggatcacctgaggtcaggagttcaagaccagcctggccaacatggtgaaacgctatctgtactaaaaagacaaatttagcagggcgtggtggtgggtgcctgtaatcccagctacttgggacgctgaggcaggagaatctcttgaacccggaggcggaggttgtagtgagctgaaattgcaccactgccccccagcctgagtgacagagcgagactttgtctcaaaaaaaaaaaaaagaaagaaagtgcatcctctggtaggccttgggccgggggcgggcatgagagagctgcgctgggatgcgctgccagggcacacttggtgggtcacacactcttgtcaactgtttgggggctggagagtagtagcactcagctcacacgggccttctgcagggagtggtgggagggcctgtgagtaagggctccggaaggcccatcattgggacctggtgccgccagtgggagcaggaggagcctgtgccttctctggcgccagtcatcccagatgccactcagggcttggctgggtttgccagctctccaggttggcactggtaacgccaagatggtcctgggagcccatctccattcagcctcgagttccctggcttcactgagggaggagccgtgataaggtggctgtgggttcgcattttggactttgttatgtcagagtctgctgtgttttgtgtttatggtggcagctggatgagggccagcgacttcaggtgttgactgtcatggtgggcccaacagtatccctgcagccacagcatcctgcctgctgccctttgcctgtcctgcagacgccaaggccctagagctttgctttgatgggatgtacccatgtgggtggacactggagggagctggaggggatagaagcggggccttcactaggggccaggacagacccttgcactgtgaaaagaggcctgggaatggaactgtccgatgttctgaaggcacacggggccccgccgtctggagcaggggcaccttgcgggctgcatggccactctgtgacgctcgttccccacagacgtggttgagcttgcattttctcccctcagcacagtctcatttgggaagaggaaagggaaacttgcacgcatgggccggtcagggcactgagaggcctttctgctctggcactgcctgccaggcgtgcacctcagggggcccgtccgctctagcaggcaaatggggcgtgttctctgtagtcagaggggctgtgagaagacaggaaagcgagcttagtgggtatcaggcaagggggtgaaattgggttgtgagatgagaaagcagcgtcattgcagggctggggggccgagactcggcagggtcgccgagagctcagtgagcgagcaatgcacaggcggctcctcgccgcaggggcctctgggggccgaggggctctgggcctgcaccccctctgtagacacctggcgagtgtccaccccttggcccagctcctttcctcagttttcctcgggcgtgctcccagtgctttgtttgcttggctgtgggtggtgacccgcccatgctgtctggttgatttaactggtgtgtcttccagctacaagaagactcaggaaactctttcacaggcaggacagaagacttcagctgccctgtccacagtgggctctgccatcagcaggaagcttggagacatgaggtgagacgcaaccctgactctgctgccctgagacctggccaggagtgaggtgaggtgttggaggtgctacaggaagcctgcctggagatcagggctcagatgcactggctcagggatgtggccatccatcatggccccgaccagtctgtgtgcagacccttgcctgggaggttcgtccatccccgttggctgcttttctgccgttgctgtgttcttcagggagggttggctgccagtgctgttgggtaacttgtggtgctcggggttggtgagggaggagtctgcaccttgaagcttcactgagtggcagcgactccagcccaggggtcagagtcaggtcagtgtgggacggcagtcctccaccatctctaggacaggggctcggcgtggtacttcctcaggctgtttcccaggtctcagaaagtgcagtcagacgccaggaggccctgaatgagccttctctcccagaggctggtgaaagcctcctggccatcagaggtccctcagcaagcagggctggggccaaggagtgagcagggggccggcgctttgtggctggcatgtttgctcttccttccctgttctaggctccctgactacagcatggtgatgaggggattgagccagaagcctgggtatgatgcttggctgggctacctcctggctgggcaccccagctgggcctcaggcacgccttctttcacaggggttgtaggagtggatgatataggttgtcaccatcaacagcatcctggccccaacttctgggtgctgctgcccaccctgccctgacccctttcccattctcagaactggtcttctggcttttggatctcagggagtgcctccctgtagctctgacccaatcctggcaaagatgggtgcaggcttcctaaaggaccggtgtgtggagcacagtgctgaccccacccagccctcccctcttcccctcttgtggcccctgcaggattcagagatacgtacatctcctgctgggctgcctgcctgcctgcctgcctgcctccctgcctgcctgccttaggttaggtgtgtcctgcctccccgcctgtggttgccaggtgggggtcgtcctgcgccagtgctttcccctgaccactaagccacaggccaggacacagacggccacacacacccagggacccaccctgccaagcagaggggatggccactgcccaggagctgtgcccacttttatttttgtttttttgaggtaatctaccttcccatccctgcaacttctatttcgagaagttttaaacctctggagaagctgcagtcatcagtatgcaatgtgtgtgtttcctctgtgcaccctcacacgcccaaggctccacactccccagcagctgtgacttgggggggtccttgtggggcaccctacaaatgcaggtcttccctaccactgctgagctttggacccaggagggaccccctgagtttcagctgaactcagcctcgcagggctgttttcttcccgaaaatgctggtctcaccacagagcatcttcaggaagtaacaggtgtttgttgtgcctaaattatgccggccatcaggaggcgtttgcccactcttagtgtccacactcccttttgagtttgttcagaccattgtggtggaaatccaaggggcacgtggagcccttggcactgattggaatagccgtgcacaagccagtcctagggttttgatctgggcatttgtttgtatggcctgtttttctctggaagcacagggacacggtcctggttctctgtctgctcctccttctctgatggggagaaaggctttcgctctctgctcagtcctggggttggcagctgacccgtgtcgtgtagcctcagggcatggctggcagtgagcagagttcctgttgcagtgacgctggcacagctgtcagtgtgcccagccacactgtgccacgtgtttgcacgtgtgccctggtacatggggccagctgggggagcggggcctcaggctgacctgggacgagccagctcgctccagttggctggccgtgttcacggtgcccgtggagggtcctgtttgctggtgtgtcttgccctgcttgctcctccatttatgtttgtagtggtggtgggaactctgacgtctggagcccctggtgtatccccatcatctccccaagcagtcacaggtggtttctgaggtctgggcccattcacctcgagttagagactgaggttgagagctcactacttcctgaaagtgaaaattgggttctgggaggtttatgtcatgagtttagggctggatgaaccccggcggacccctgctaactcttgggcggaagcccctctggacagctgcccaacgcccgtgtccatgatgggcctgtcccagggcagccccggtctgtgaggcctttggtgtgccctggggcatgggtgatggggatgggaggaagggaactggattcaggtcagagtgggggtttacagcagggtcaggtcaccgtctgactccgtggtctcagatgaggcatcggccctctcaggacctcgggcgagttgagtgtttctcagttcttcagtggctccctccatgtcagagtgggcctggctgcagtgagtggcagcagctgcccttggacacacaggtttccaggttggcgtctgtgggcacggatggagcgcagagcagaaatgctcggcgccaagggtgtcccacatcctcccacggtgcgtgtgctccctcagctgacgtgatttggggaacacgggccgctctcgttctgtggagctggccaagcccagctgtcatgctgtggcacatttcacacctttgcgctgctggatggggctggttgtgctccaggtgctgtggcttctccaaacaggtgtgccttggggcataaggcgtggacagggcgtggacccaggggcctcttgggcacagccgtgaggctgagcagttgctagtcatgatcttgcgagagcctcctgttgagtcaggacttgaggagactggagacagtgctgctgtccccggtggtgtgcggactggaggagccgtcctggagggtcttcccctgctgggcctgactgagcacgagcagggggcctcccctggggctccccgaggagggctgtgagtgggtgctggcctcccttgcttacacttcgtttcctcttctctcctgctgccaccttccagggctcatccattttcacactcctttaggtaaggctgagcctggacacacctgtggaagacttttctctgaattggggcagggtggactccggcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggttggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagccaccgcgcccggccttttttttcttttttttgttggagtctcgctctatcaccaggctggagcacagtggtgtgatctcggctcactgcaacctccagctccctggttcaagcggttctcctgcctcaggctcctgagtagctgggattacaggcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccatgaggccaagggaggaccctggggtcgagtttccttcgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattgaggactccattcccttggcaacctctgatgactaagggccggtaaaaaccccctctaggctgacgaggaagagctggtagggggtcaggctcttcacctgcagcctccagaggagatccttgtgtcaaactgggccgtgtcctttccaagtcctgaccctggctgcctgcagtgggtggggtggggttcgaggggctcgcacacagatcctggcacttgccctggtgggctgtcactcaggacacttcacggtctcagccttcacggaaacacccagagctgtggtccttattctgtgcctgtcaggcaccaccctgattctcaggattctgtgcctgtgccgtgaggcactgccctgattctcaggagagcccagaactgtggtccctattctgtgcctgcgccgtcaggcaccgccctgattctcaggagagccctgttctccttgtggggactctggctgggtgtcgcagacgtgctggcctctagagtccccgggcctgggaggggtatctgtttgtgtgggagggactgagtgggatggagctggcctgctttctcctcttgtctccttatcactctgctgtcccagaagtgtccttggtcttccgtttgcttctctgagagatgtgcatgaagaactgcacagacttttcataacttcagtacgagagcccagggtgtccctgtaggggacagcagagaggggccgacagccccccaactgcgcagacttttcataacctcagtacgagagcccagggtgtccctgtaggggatagcagagaggggccgacagccccccaactgcacagacttttcataacctcaatacgagagcccggggtatccctgtaggggacagcagagaggggccgacagccccccaactgcgcagacttttcataacctcagtacgagagcccagggtgtccctgtaggggatagcagagaggggccgacagccccccaactgcacagacttttcataacctcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtccctgtggttgttgggcatggccgacctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagttatggtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgtaaatggaacgatacagtgtgcagctttttggcattcactgtcttcatttggcatcgttctctggagacctgttggggctggtgcccgtccgtgatttgctccctgtccctgctgagcagtgttcgtgttacataagcttttgtagagcattgagcatgggcctgggatctgccttgtgttgtgtgctctgtctcaggtttttctgtcttcatcttttctctcctgtagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcctcggcttgtgtgatgtatcgttcgggaccatgataagagtggtaaatgaactggcacacggtacctgccctaatgagtccgcacccttgggagaggcaggcaggggacagtgctaaagacaaagggcaggtcctcaatgctgggacaaggggagccagctgtgaggggagaatggtatatggccaacctgtgaggtcagacccagcgtcttgggaagaggagttgaaactgagccccaggaggcggaggaggagctcaccaggctccaggttgggccgggagctccagaggcttcgccagctgcccctgcaagcactgagctgctgctgagcacacctgtagtccccgccattctggagggtgaggcagatcacctgagcccaggagttcaggaccagcctgggcagcataccgggattccatctcaactaaaaacagtaggctgggtgtggtggctcatgtctgtaagctcaggactttggaaggccaagatgggaggatcacttgagcctgggagtttgacaccagcttgagcatcgtagccaggccctgactctacaaaaaagtgaaataattagccgagtgtggtggttcacacctgtaatcccagctgctcaggaggctgaggtaggagaatcatttgaacccgggaggtggaggttgcagttagccgagatcacgccattgcactccggcctgggcgataaagcgagactctgtctcaaaaaaaaaaaaaaaaaagaaaaagaaaaaggaaaagacccttgagggggaacctccactctgcccctggtctggcgctttgcatgtatccattcctagtctttggagttcccactggaaaactagtgggagcaccagtcttcctttggaggtcagaggtagctgggctcaccccagatgtaagagcagggaaagttaggtgacctcgaattgtatggtacataagccccaatacagcagggagctggtaccaataaagggtgaaatgcactattgccgcctgcagtcaagatttacactaatttattttggaatgagttcatgtgttcttcatttattgaacagatactgtaactgccctgcgggtaagagtctgctaggttttgtggggtacaagggtgaatctgatgtggacccagtgctcaaggactttgcaacccgtttgttggggaagacagattcccctaagtcactggcttgtgtttgacgaggtgaagcgcttggagagcttcgaggatggagcaagtggagtaagtggacctgaggagcgggcagcaatgcctgaaggctcagtcccctcttctcagagtgagggtaatggtatctgcctcatcatattgaaaggcttaaccttataaagcacttagcacagggcctgatgtatcagaggtaaacatcagactcttcccaactgtagccactgtcaactttcctgtcttcttttttttttttgagacagggtctcactctgtcgctcaggctggagtgcagtggtgcaatctcagctcactgcaacctccacctcctgggctcaagcgatgctcctgcctcagcctcgcgagcagatgggatttacaggggcatgccaccacgcccagctaatttttgtatttttagtagagacagggttttgccatgttggccaggctggtcttgaacgcctgacctcaggtgatccgcccaccccggcctcccaaagtgctgggattacaggtgtgagccactgtgcccgggcgtaccttcctgtcttattttctccaagcaggctggaatgttcatggatagatatatgtgtgataatatactttttacatatcatgcatcgtgctcattttagtttcaggagttctttgctcctgtgtagcctttctacacattatctttctttttttcttctttttaaataagagatggggtcttgctctgtcacccaggcaggaatgcagtggcacaatcatggctcactacagccttgacttcccacccgatccagcctcctgagtagctgggactacaggggcatgcatgccactgtggccgggccaattaaaaaaatttttttttatagagatggtggtctcactatgttgtccaggcaggtctcaaactcctgggctccagtgatcttcctgccttggtctaccaaagtgctgagattccaggcgtgagccatgggtcccgttgtatacatttcagtaactatattattccatttgagtgctcacttgtgcagttgggcaggtttccattctcgctattaaaaatagtgccttcatgaatatttcagtgcatatacctttttctgtatttaggaatattttctttggaagaatgtccctaaagtggaactgctaggtctcagagggactcacttaaggctggttcattcattcttgcagctcccagcacaagtggaatatagcttcaatctgagatcggtaccaggcccatttcattctctcatccctccaattctggcctgaaatatttcattctcttggaatctatagttgtagatatgaacctggcctttctgcttcttgggttccataggccttttcttgctgcctgcttgatgttgcgcagcttaatgactgctaggaggcttcccaagctctgacacttccaggctgtgagactggaacaagcttggcaattcaagaccggcattatggcagtgagttatgagggcagaggaaggaggccagagcgtgttgagagagaatttgggtttcacgcagtgtgtcacgggaagccttggatgctactgggtttgttttaaaaagatgaccgcactgaactcaggtaaacgggcaagggtggaagcgaggaggcaggagcaccggccgcagaggtctgggagcttctaggatgggaagtggcccaggcagcctacgcggggcaggccgtcagtgagtggcggagcgcctgcagttacagggacagggaagggtggccgacgggatgggcaagggcagagggaggtggagtggacgttcgtggtcctgcctctccacgctgctgtttggagatgattccgggagggtgggagggcgctggcgacggcatttcagtggttggacaggaaggaaggaaggacgtcccatctcggcgctccagggttgagcaaatgtcagtcccaggacggtggctccgggtgggggcgggggcgacggtccgcagccgtctcccaccagctccctgttcagttctttgatgagaacgattacgttttctcagtcttacttaaagcgctgagtaaactcacctgcaagaccagcaagccctgcgcttctctttctgcgcggttccccgcagcacatggcgtgtccacccgggacccacctgcggccacctgaagactgggaggactggctccgcccccgcgcttcgtccccgcccactcatgggcggagcctccacagggcgcctcggccccgggctgtcactcgggactccgccccttcatggacggagcctccgctcggctctctgagcgcatgcgcagccggtcccacccgcggctccgacacgccggagcccacgtccttccgggagcgcgcgcgccggtgcgggtgcgtgcgtgagcgtgctcgtctccgctgccgctgccgctgccgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcaggtgagctcgctgcgggtcgggcgggcggatcggcccacgtcaggcccgggcaggcgggcgggcgggcgcgggtggggggcgggggcggcactccagagccggaaatggcggcgacccccgggccggggctgcgcgggcgctcggggccggagctgctgcgacgccgcggcctgggccggggcgggggcgcgggaaggtcggcgccggggcctgcgggagccgggccgggccgggccgggggtctgagcaccgtggtgggggctggggcggcgctctccgcgggtctcttcgggcccggacgccccctccgctcccccaggtccccgcggccgcccccaaccccccggggtctcctctcctgcggggggactggagaagctgggccatcgctggtcttagggaggcagataatttagtccctgggtcgttgtgtttatagctcggggaattgaaaattgttctgtaacgcatcgtaaattaatctttccgacgttgtaaattccaaaaagcatttggtttgttagaaaaaacctgttttctccgctttataaaaacatttgaagccatgctttatattgaactcttaaggagagtattaggaactcgtccgttcaggttctaacttgttggtgttaagtgtctggattaaagactctctttttcgtgtgccgaagccatgatttctcaaattcattcagttgtgtcatacaggaaaaggaagcaaaaatttcagctttatttttgttttccggcttaggcttggttgggaagatttgatggtggttagacacgtctgcccttatttgcctgtttagaaaaacctattctaatgacaaaaacagttacattgctcccactattgtcatggttacctgaaggcaaaagtttactcaaagcttctgagattttatgttcgtttatttgcttctctttttaaaaaaatgtcagctgagtttcaggaatgagtagtctgtcaaacaagagatgaaattagaagcctggatctaagggctttggggaagtttcggttgagttcccctttcacttgtgtcggtgctgtaggactcggggtggctccagctggcgtctggcccagcagagagctgtaggggcccgctctggttgctggctgtgtggactctgagggacacccctggcgagggtgttaatgagcctgcagcgtctgagtccacccaccctcagactggcccctgactcactctgcacctgccatatcagcctccttgctagttctgaacagagccacatgctctgtccttggatcttcctggaatgcctggttccttaaccccctagcctggcgactgcctgcctgccttgccacccagttcccttcctcgcttaattttcccacagcgctgaatcctcctagtgtcctgcttaatgcatttatcatacttaatattttactgtgagttagtaaggtccgtggagagaatgttttgtgaaaaaaacagttgctggcacatgatcggggcccagtaaatatttgttcagtgaatgaacgtgaggagcttagcagcagctgtgcgtggtgctggccttgtcacccggaagtccttgtcggtgaggactgagcatgtagaggtaagggttcctggagtgttggccctcaggacagagagccaccatctctcacctgcccaatgaggaaagacagccaggtaaggggtggcttggaagggtgcatgggacccttgtaaatcttttcgcaactttgaatctataattattttgaagttaaaacgtttctaaaaagtcagatctgttgggggcacagtggctcatgcctgtaatctcagcactttaggaggctgaggcggacggatcacttggagtcaggagttcgagactagcctggccaacatggtgaaaccccatctctactaaaaatacaaaattagctgggtgtggtggcgtgtgcctgtaatcccagctactagggaggctgaggcaggagaatcacttgaacccaggaggcggaggttgcagtgagccgagatcgcgccactgcactccagcctgggcaaaaagagcaaaactccatcttataaaaaaaataaaaataaaaattagctggttgtggtggtgggcgtccgtaatcccagctactcaggaggctgaggcaggagaatcccttgaacctgggaggtggaggttgcagtgagcaaaggtcacgccacactgcactccagcctgggtggtagagcaagactcagtctcaaataaataaaaataaataaaaagtcagatctgccagtggtaataatgcttttagaaattttgtctttgattaccaggaaaaaccctacatgctagtccttatactccgtcgtgacatttggtaattaagtagagtgaggtggaatgatctccctggctcttaattcaggaggactgcctgagagtgactgtggctgatccccttagcatgaggcccttcagctgtggtgctgtgacagagccacagaggctgcttggtgacttgcagactctggagtcctttccacagcctccacctcatgcctacattaactcagagtgagtgggcttcagggccttcctgcatccctgaagatggttgtattaacgtggttcagagattgaacagacgctgcacgtttctcaggcatttttcctcagttccccttgcttggagggtggataccactgagcctggttgtacagctgcctccgtgaccagcacctttgcccaaggtctccctgttaacaatcgtcagagctggaacttgaactcgagtcttctctagaccaggtttcttctaagtatttggcatcaccaggaagagccctgtacaaggtgctggtggttttatccttagagcccagatgtgaggtgctcacgtgtgtgcctggggttagcagttggtgtttgttgaatgaatgactaaaatgcagtggggcggggagtcatgataaggtagaattttatctgaggtggagtttgcttctgaaatcaggcagtaaggtgaatgtgatacccagttaggagtatgtaatgctgcaggtaaactgtaacagcaaatgaaagcagtatttctccaggaaggaaacagacccctgggtcctcgggctgggttggaaaaagccatttgtagagaaatggaacatggtggctagccctgcacaagacatagagaagagacccttaacactccagttatctccaagtgggcagttagaatgagtgcttctaggccgggcacggtggctcacaccagtaatcccagcactttgggaggccgaggcgggcagatcttgagatcgagagatcgagaccatcctggccaacatggtgaaaccctgtctctactaaaaatacaaaaatagctgggtgtggtggcgggcacctgtaattccagctactagggaggctgaggcaggagaattgcttgaacccgggaggcagaggttgcagtgagctgagatagcaccactgcactccagcctgggcgacagagcgagactccctctcacaacaaacaaacaaacaaactgcagtgcttctaaggtgagactcatcgtgatgttctgattagaacgttctcgtgccacaaagtcctgagatgtgtccaagaagcaccgtcttctgtcagacacacctcctgccccgccataggccttcccactgtggcagcagaatctgtgctaggccttccttcgtgaaagaggacaagatcagggctcacgtgactggggccgctgtgactctgagcctctgcgttctgtcagatgagggtagtggtgcttcccctgcgtcctgctgggagaaaaaaggaggcagtaaatgaaaggtgtctcatcacctgcttcctaaatagaagggacaaagaggctgaaaaacagtaatagtcttgttttatgaaaatgccacccctaatctaggagctgggactgccatgccaggacccctcagataatgacatccctgaagaggattagcagctagtctgttatcagtcacaggcagttcaacccagaagatttaaggattagattacccaacaaccttgagtgtagattttgtctctcatcaccctttgcattaactttgggtgcatgtgtgttaatgaggaagtgtgttctgctttattcttggtacatcacagacatttaatagatacaggtcattagaaataaaaattgttttaacttgtatgagttttgcaagcattgatatttcaaattgaaattgcagaaattaggacagcatttcattttcttttgtttttttgagacggagtctcattctctcacccaggctggagtgcggtggcgtgaccttggctcactgcaacctctgcctcctgggttcaagtgattcttctgcctcagcctcccgagtagctgggactacaggcggtcgccaccacgccaggctaattttttgtatttttagtagagacagggtttcgcggtgttagccaggatggtctcgatctcctgaccttgtgatccgcccatcttggcctcccaaagtgctgggattgcaggtgtgagccactgcgcctgggcttttttttttttttttttttggttgggggacggagtctcactctgtcacccaggcttgagtacaacggtacggtttccgctcatggcaacctctgcctcctaggttcaagtgattctcctgcctcagcctcctgggttgctgggattacaggcgcctgccatgacacccggctaatttttgtatttttagtagagatggggttttgccatgttggccaggctggtcttgaactcctgacctcaggtgatccacccactttggcctcccaaagtgctgggattataggcgtgagccactgagcccagccccaagttggtcttgagctcctggactcaagtgatcgtccaaccagcatctcattttctaaagaaagaagtacttagaccaggtttgggacatgtctctgaaaattctgggctggtgcagtggctcatgcctgtaatcccagcactttgagaggccgaggcaggcggattgctagagtccagaagtgaagaccaggctgggcaacatagcaaaaccccatctgtactaaaactagaaacaattagccgggtatggtgacatgcagctgtagtcccagctactcggaggctgaggtggtaggatcacctgagcctgggaggctgaggctgcagcaagccatgattgctccactgcactccagcctgggcgacagagcaagacactgtctcaaaaaaaaaaaaaaaaaaaaaaaggaagttctgtattgatcaataatttcctcctcaggacagacctgcatatgccacaatttaactttgttgcaacatcattctacattttgcatgaatggtttcaaaaaacttatttctatgacagagaactttgtcatttattcttgacatattaaacctgagtgacatttttaaatttttgtgttgtgttgtgagtgcttagtgaagattccttgaatatggatgtgaatgaatcttatttttcatgggtttataattgtattgtccctttaaatattctacattgaacatgtatcaccagcagaaataatcatttacgaggtgaagtgtccagagccatgtagtgtctgcattgctgtgtccagggattctttgtttgtttgagacggagtctcgctctgtcatccaggctggagtgcagtggcacgatcgtgtctcactgccgcttccacctcccgggttcaagtgattcttctgcctcagcctcttgagtaactggaattacaggcgtgtgccaccacgcccagctaatttttgtatttttagtagagatggggtttcaccatgttgtccaggctggtctcaaactcctgaactcaagtaatcaacccaccttggcctcccaaggtgctgggtttacaggcatgagccactgtgctcaatctgcgttctgaggcattctgtgcctgttatgaaatcatgatgctggcaggtcggaagatggaatcgacttcccagccccatcggctgtgccctgccctccttgctgtctctagagcgcggctgacttcggggagagctctccctgccctgtgcctctattttttcaccaggtagggtggaaatgtgttctagtgaaactgcagaacgaaaatatcccgtcttactcttgacccttgaagaagcaggagctgaattcaggtgccagaggctgcgtccgcgcgctccacatcagtctcagagtggaggcgagcccaggccagaggcctctaccccggacgaggctgcaggtgcctgacgggaggagtgactgcagctcagcagagggagtgtgtggagtgtgcggccctgcctggcttttattttgctcctcctgttattgggagggattagcagcagagcgaatgtttggatctttgctgagcagtcccatcggatttttctttattaaataggattgtgttttattgtaagaaggtttccctaagacaaataacgaaggaaattctgggtccaggagtacagactgtagcttctgtcatctcttgccaagttcgtagccctcagatggtgtctgtctttcccctttgcttgcggggccttttaccacagcactttggtgttcttttagctgctgcgataggactagctgttaaaatctgagattttacatttttgccagtcgcaataaattttgttagttctttcttgatgtgttctttaaaataataatgctttttttttttgggtgggggacagagtcttgtgctgtcgcccaggctggagtgcagtgacgcgatctcggctcactgcaagctccgcctcccgggttcacgccattcccctgcctcagcctcccgagtagctgggactacaggcgcccgccaccacgcccggctaatttttcgtatttttagtagagatggggtttcaccgtgttagccaggatggtctcgatctcctgaccttgtgatccgcccagctcggcctccgaaagtgctgggattacaggcgtgagccactgctcctggcctcatcttttttttttttttttttttttttgagacggagtttcactcttgtttcccaggctggtggagtgcaacggtgtgatcttggctcaccgcaacctctgccttctgggttcaagtgattctccagcctcagcctcctgagtagctgggattacaggcgtgtgccaccacacccagctaattttgtatttttagtagagatggggtttctccatgttggtcaggctggtctcgacctcccaacctcaggtgatccactcacctcggcctcccaaagtgctgggattacaggcgtgagccaacgcacctggcctcatcttgttttttttttttttttttgagacagagtcttgctctgtcgcccaggctggagtgcagtgactcagtctcggctcactgcaagctctgccacctgggttcatgccattctcctgcctcagcctcccgagtagctgggactacaggcacccgccgccacgcccagctaatgttttttgtatttttagtagagacgggatttcatcgtgttagccaggatggtctcgatctcctgacctcgtgatctgcccacctcggcctcccaaagtgctgggattagaggcgtgagccaccgcgccctgccacatcctgttttttttacaacagggtgtcactctgtctctcacccaagttagagaggagtgacacagtcttagctcactgcattctcccaggcccaagcaatcctcctatctcagcctcccaagtagctgggactttaggtatgtgtcaccacagttgactaatgttttaatttttgtagagatggggcctccacatgttgcccaggttggccttcctgggctcgatcctcctgcctcagcctcccaaggtggtgcatgcctacagtctcagtagattagaatcaccctaaccctcagtaactgagattgtaggcacgcaccacctcactgactcacctcaaactctcttttttgagatggagtctctgtcaccagactggagagcagtggtgcgatcttggcacactgcaacctccgcctcctgggttcaagcgattctcctgcctcagcctctgtagcagctgggactacaggcatgcgccactacgcccggctgatttttgtattttttagtagagacggggtttcaccatgttggccaggatgatctcgatctcttgacctcatggtctgcgcaccttggcctcccaaagtgctgggattacaggtgtgagccactgcgctcggcccatctcaaacttttaataaggctcttcgtatagaaatttttaaaaaattaaaaacatttttggccaggcttagtggtttaagcctgtaatcccagtgctttgggaggccaaggcaagcagattacatgaggccaggagtttgagactagcctggccaacatggcgaaaccacgtctctactaaaaatacaaaaatttgggcaggtgcagtggctgacacctgtaaccccaacactttgggaggctgaggtggatagatctctcgagttcaggaatttgagaccagcctgggtaacatgaggaaaccccatctctgcagaaaatacaaaagttagctgggcgtggtggtgcatgcctgtggtcccagctactcgagaggctgaggtcaggctgaggtgggaggatccctggagcctgggaagcggaggttgcagtgggggatgaaaaagaataccccgtgtccaaatagcaaaacactctgaaatgaggcaaaccgtggtttgttgaacaggtgttctgggacaaggttgccgaatatgcattagccgtaatccccaggacagccatgcagggtgggtcttaaacagttttttagattctcgagtataaaggtataatattgaagaataagcacaaataatgtcatcatacatgttaaagtgacaacacaggatttacaaaattacccttttttccccaaaattacctcttacgatgtggtttctgttggtgctgttttctcttgcatcatcccgccaggttgggtaaccctaactgattgtcaccagcagaccaacagacagactcacagcatccttctccctggtgtgagcactgcttaattcacatttatgaaaatactttaagacaagggcactgtaactcacatagaatctgaagtggccttgaacagggagctggtccagctgcctcttagtgtgtctgacctccaggtgggcggactgagatgcgtgcaggtgttcatggtataggcatccttgtaaacctgctctggttaaggataaataggcaaagttgtgctaatgctgttcctacagcagcctttgccctggactgactccagaacagctggctgactgacagctgcctcccagtaaagccttaaacaggcttatcttatatttttaaaaggcaaaggacaataaggcagattaataaactgtgggggtttttttgtttgtttttgtttttcttgagacaaagtctcgctgttgtaccccaggctggagtgcaacggcgcgatctcggctcactgcaacctctgcctctcgggttcaagcgattctcctgcctcagcctccagagtagctgggattacaggtgcccgccaccacgcccggctaatttttgtatttttagtctagacgggggtttcaccatgttggccaggctggtctcgaactcctgacatcaggtgatccgcctgcctcggcctcccaaagtgtcaggattatagggtgagccaccgtgcctggcttttttttttttttcctgtcttttgtgtatgtgatggggtctcgctcttgtcgcccaggctggagtgccatggcacgatctcggctcactgcaacctctgcttcccgggttcaagtgactctcctgcctcagcctcctgagtagctggaactgcaggtgtgcaccaccatgcccggctaatttttgtatttttactagagatggggtttcaccatgttggccaggccgatctcgacctcctgacctcaagtgattgacccacctcagccttccaaagtactgggattgcaggtgtgagccaccacacccggggctggatttttttgttttaagagacaaggtctcacactcttgcccaggctggtttacagtggtgcagtcactgcagccttcacctctgggctcgagtgatcctcccacctcaggttacaggtgtgagccaccacacatgaccgcacatggcagattttttttttttttttttcacggagtctggctcttgtcacccaggctggagtgcaatgatgtgatctcagctctcactgcaacctccgcctcctgggttcaagcaattctcctgcctcagcctcccgagtagctgggattataggggcgtgccaccctgcccagctaatttttttttttttctggagacaaagtcttgctctgtcacccagactggagtgcaatggcaccatcttggctcactgcaacctccgcctcctgggttcaagcgattctcctgcctcagcctcccgagtagctgggattacaggcacgtgccacctcacctggctaatttttatatttttagtagagacggggtttcaccatgttggccaggctggtcttgaactcactgacctcaggtgatccgcctcagcctcccaaagtgctgggattacaggcgtgagccactatgcccggcccaggattttttttttaattaaggaaaatactttttacatctaaaattctacgcgacaataattaatgtgtcttcaagctgagaattaattaaaatatagccaataaaacatgtattaagctttgtaaactttgtctatatatgtacttattttacttttatttaaaaatatggggccaggcacggtggctcacacctgtaatcccaccacttcgggaggccaagacgggtggatcacttggggtcaggagtttgagaccagcctggccaacatggcgaaaccccttccatctctactaaaaatatgaaaattagccaggtgtggtgcaggcacctgtaattccagctactcaggaggctgaggcaggacaattgcttaaacccagaaggcggaggttgcagtgagccgacattgctccactgcactccagcttgagcaatagaaagactctgtcttaataaataaattaatagccgagcacgctggctcacgcctgtaatcccagcattttgggaggccgagacgggcagatcatgaggtcaggagatcgagaccatcctggctaacacgatgaaaccccgtctctactaaaaatacaaaaaaagccgggtgtgatggtgggcgcctgtatatagtcccagctactcgggaggctgaggcaggagaatggcgtgaacctgggaggtggagcttgcagtgagccgagatcgcgccactgcactccagcctgggtgagtgatcgagactctgtctcaaaaaaaattaattaattaattaaaatatgacagtggcctgggtgccatcgctcgcacctgtaatcccagcacattgggagtctaaggtgggaggatcacttgagctcaggagtttgcctagcctgggcaacttagggagatcctgcctctacaaaaaataaaaaattatccaagtgtggtggttgcacacctgtagtcccaactacttcggagggttgcaggagtccaggaggtcaaggctgccgtgaggtgtgattgagccactgcactcctacctgggtgatatagtgagactctgtctctaaaataaaataaaataaaataaatgacagtggtccatatagtaccttattcagaaaaggcttgatgtacaagaaaataagttatttgtgatcaggacagagaagaattactgccttttgtgaaatggatgctgagaatcagttacgatgtacggtgcttgggaggctgactttgatttcagttacagccctgctgatccttagcacggtgactgcaaataggttactccaccttcctgagtctcagtcttcttagccgaaaagcacagatcatcatcataatagctaacattaactgtgtgcctggcatagggtctgaccgctttattcaagccagctcccagacataccttgctggactgtttaatgcccattcgacaaagaggagatcgacatggggaggtgttgagtaacttgcctggccactgagtccctgtcaatggcagctcagacaggtgaccccagagctaccctcccaccccctgaccaggcccgtctcacaggcctcttaggaagggctctgttcagtagatggcaggcacgtggtaagtgtttcctaagctgcagctgctgtgtagataaaactcaaagcagatatcacaagttttgtcagatcatactgtctcaattttgaggtgaatgcatgtgttttactacttaactacctctgaaatttaggggttttttgtttgttttgagacggagtctcgctctgtcgacaggctggagtgcagtggcgcgatctcggctcattgcatcctctgcctcccggcttcaagtgattctcctgtctcagcttccccagtagctgggcctacgggcatgtgcaccatcacgcctggctaatttttgtatttttagtagagtcggggtttcaccaggttggcgaggctagtctcgaactcctgagctcgtgatccccccaccttggcctcccgaagtgctgggattacaggcgtgagccactgcgcctggccctgaaatttcgcatgttttacggttggcttgttagggttaaattggtgcaccttatacttggttgcatactagactcactggaatgatttgactttcgtcatagttgcagaggcactctgaaaccctatgtatgtgcttcaccagggacagccccacgcatgggaggtggtggccagccatcaccccagggtgaatttctctaagagcagtcctaggccagggggtgagtgtgggaaagtcagggccgtttccatcagttaacgtttcagagcgggttcccgctggaagtgctggaaatacccagatgccatctgtagcattttatgaactgtggcggatccactctctgtgtcttgagcttctgctctgtggtctgctcagtggaagcatcctgtcagtccactgtacagtggggtggagccgcagccagggtgggtgtgccgtttgattggtcacggaatgaacagggcaaaggtcactaagtagatatgatactgcaagtaggattgtggtcataggtatttttatgaatttgtgttatgtgaagttgaggatttgaatgttgtgattattatatccagataaagttctagcctggcacagtgcaggcacgtgcctgtggtcccagctgcttgaagtgggaggagagcttcagctcaggatttccaggctatagggagctgtggtcccaccattgcaccccagcctgggtgacagagtgagaccccatctcaaaaagaaaagaaaagaggctaggcgcagtggctcaggcctgtaattcaagcactttgggaggctgaggcaggcggatcacttgaagtctggagttcgagaccagcctggccaacatggtgaaacccccccatctctattaaaaatacaaaaatcatacttacccggcaggggagataccatgatcgcgaaggtggttttcccagggcaaggcttagccattgcactccggatgtgctgagccctgcgttttccccaaatgtgggaaacttgactgcgtaatttgtggtagtggagggactgtgttcacactgtcccccccgcccaaaaaaataaaaatacaaaaatcagtcgggcgtggtggctcacgcctgtcatcccagcactttgggaagccgaggtgggtggatcacctgaggtcaggagtttgagaccagcctggccaacatggtgaaaattgggaggccgaggcgggcggatcccaaggtcaggagatcgatacatcctggctaacacagtgaaaccccgtctctactaaaaataaaaaaaaaaaaattagccgggcgtggtggcgggcgcctgtagtcccagctactcgggaggctgaggcaggagaatggcgtgaaccagggaggcggagcttgcagtgagccgagatggcgccactgcactgcagcctgggcgacagagcgagattccgtctcaaaaacaacaacaagaacaacaacaaaaaattagccgggagcagtgatgcgtgccgtagtcccagctactctggaggctgaggcaggagaatcacttgagcctgggaggcagaggctgcagtgagccgagattgtgccactgcactccagcctgggcgacagagcaagactccgtctcaaagaaagaaaaagaaagaaaaaagtcttccccgtgagagtagatttctactgaatcgattgctggttttatgccttttcttccgtgataggaagtatgtccagactcatctggctggggatcctcaggagagcctgcggggggcagcagaggcccgcctgggccagggcgtgcaccagaccagaatcctgcggatttagtattgtgagggtagaagaccagcaagcagcatgacctcgtggttactgatcttatgaagaacacttgtctttcatatttgggactgtgttaaggttttctggaatatttttggttgtagtaacgattctgctttaggagctttcttctctagtgttgcacagacctgagtgatttgaccagcagtgctgcggtaacggaagaccactcgtgtcttcagactcgttctgttcctgggggtgcttgcttgttctaggccccctttgtatggagaggttcaaaccttgattgaatagtcgctacccaggtgtcataacctgtggcctcattggtgtcacctggactttttgtctgctgtttgcaccatcgaaagtgatgtgcgctggccgggcgcggtggctcacgcctgtggtcccagcactttgggaggcgggggtgggcagatcacaaggtcaggagatggagaccatcctggctaacacggtgaaaccccatctctactaaaaatacaaaaattagctgggcatggttgcgagtgcctgtagtcccagctactcgggaggctgaggcaggagaatggcgtgaacctgggaggcagagcttgcagtgagtggagatcgcgccactgcactccagcctgggcaacagagcgagactccctctcgaaaaaaaaaagtgatgtgcgcttgggactgggagggcgaggcccgaggtacctgggtgcccgatgcccaggagggcatgagtgtcgtgttggataacctgctctccaagtaatagggttttgagaatgtttttttttttttttaattgagacagagtctgactctgtcgcccaggctggagtgccatggtatgatctcggctcagtgcaacctctgcctcccaggttcaagcgattctcctgcctcagcctcccaagtagctgggactacaggtgcccgccaccacacccggctaatttttgtatttttagtagagacgggggttcaccatgttggccaggctggtctatctcctgacctcatgatccgcctgccttggcctcccaaagtactgggattataggcctgagccaccatgcccggcctgttcaattctttgtattcaaatgtatatctggagttattttgttcaacttctgatctgcttttctttttgaattactgtattctaagcatcagtttacaagaaaaaaaatctttattaggtttccagacccaagtcaataccaataaaattaatgcagcaaacattcactgaatgctctattaggacctggggcagtagatgagtctgtgaattaaaagggcttcagcatgtggggtttggttttgtttctctgtagctaatcatacctttggaatggttttatagtttcaggaaaccgtggttctgggcagggtggcagctatgggttgaggcagttgatccttcctcaggtgtggccgctggtcttgttgcttcttgacattaactttgtgactcacgagggcaggcgttcgttttctgtggcactctgtgtgtgagcgagcatggggcttgttactgtgtgaaaagggccagctgccctgcctgtctgctcctccctggctcggccgggcgctgccatggctccagctcagattcacttcctctcgtacttggatgcttggtgatggtcgtggaagcagttttattttctcttgctgttctcgtgttgcgttaagctcagcatcactgttgctttttattcttagaattaaggaggaaagctgaaatcttttggggatttctgtgtttccagggactttaggaattcttttttttttttgagacagggtcttgctctgtcaatcaggctggagtgcggtggcgcgatctcggctccctgcagccttgacctcctgggctcgagtgatcctcccatcccaaccacctgagtaactgggaccacaggtgtgcaccatcacgcctggcgagtttttgtatttttttttttaatagagatggggtttcaccatgttgcccagaatgatcaaacttctaggttcaagcagtctccccacctcagccttccaaagtgttgggattacaggcatgaactgccatggctggctggaaagtctttacatttgaaattcattttaagttaggaggaaaggcctagcacactggctcatatctgtaatcccatcactttgggaggctgaggtgggcggatcacttgaggccgggagtttgagtccaacctggccaatatagcaaaacctcatctctgctaacaatacaaaaattatctgggcatggcggcagatgcctgtgatcccagctactcgggaagctgaggcaggagaatcgcttgaacccgggaggcggaggttgcagtgagctgaaagtgcactactgcactccagcgtgggcgacagagtgagaatcggtctccaaaaaaaaaaaaaaaagagtaaaggtgagggacacctgtgatgtggcacacagcgtcttttctctagcttgctttgttgactcttgtttataatttcttcaaatgtatttacagagttaattgggttttttttggaatagataatatctattccaaataaaaatccagaaatacacattcaaactgtggggcttttacccttttaactgtgttccaagtccctgtccctagcatgctctgattgtcagtccttcccttgcctgacctacctgtctgagtatcctttggcagtcaggtttttgtttgtttgtttttgagacggagtctcgctctgtcgcccaggctgcaggctggagtgcagtggcgtgatctcagctcactgcaacctccaactcccgggttcaagcgattcttgtgactcagcctcacgagtagctgggactacaggcgcctgccaccacgtccagctaatttttgtattttttagttgagacggggtttcaccatgttggccaggatggtcttgatctcctgacctcgtgatctggccaccttggcctcccaaagtgctgggatgacaggtttggccaccgtgcccggccggcagtcagtttttacatggttcatcacagattttaaattaagattccccagcaggataaaagaaatgccagttgtattttatttttcgtatttgtatttttagcaattttttttttttgtatagaatgagccaagggcatctagagcaaagaggtagttccctgccccgtctccatctccctgtctgcactgtctctcccagaggtgtttgctggtgccttctttgcagttccctgtgctgtgtcatgcccgtttgctgacccagcccctgctgtgtcttccccatcccagtgtgactgtcgctcttggtagttcctccgtgtttcctttgtttccttaggtgacttgtctttgccccactccctgcagtccgcagcacctgttgtctccttccctctcctcccgcttctcctcagacgtcatctgttctttctagagttgttccccttgccccagggtccagggttcctaacagcctgttttttttctttctttttttttttttagtgagacagagtctcgctctgttgcccaggctggagtgcagtggtgcggtctcagctcactgcagcctctgcctcctgggttcaagtgattctcccgcctcagtcttctgagtagctgggactataggcgtgcactaccatacctggctgatttttgtatttttattttttatttattgttgagacagggtctctttgttgcccaagctggagtgcagtggtgccatcttggctcactgcaacctccacctcctgggttcaagtgattctcctgcctcagcctcccaagtagcttacagtagggattgcgggcacctacgaccacgcccagctaattttgtatttttagtacagatagggtttcaccatgttgaccacctggtctcaaactcctgacctcaggggatccgcccaccttggcctcccaaagtgctgggattgcaggcgtgagccaccgcgccaggccctaacagccaccttcttagcatctgtatattcagaccgtccattgcaggatgtgtgatctttgtggcctggaatgtctctctctgagcactccatcctcccacccctcaggcagtgtctcttgaggccacctgcccagccaccatcttggggggaccacaggaggctggggagagagcgaggcagtagtgagaagccgggacgctcaccgttggccgagtaccttagagcagccctgacgcctgcttctgtctcttggtgaaagtggcgcccagacttcagtccttacagcccagaactcagaaccgtggaggtgctgtgacccacagggtttaccttgtaattgttgttaaaacccttctgggcttcataatggaatgcttatgttgaaatattattttaagtactattatctatgatgtggttagaaatgccaaagaatttttagcttttttgagacggagtcttgctctgttgcccaggctggagtgtagtggcgcgatctccgctcactgcaagctccccctcctgggttcacgcgattctcccgcctcagtcttccgagtcgctgggactacaggcgcctaccaccatacctggctaattttttttggtattttttgtagagacggggtttcacgacgttacccaggatggtctcgatctcctgacctcgtgatccacccgcctcggcctcccaaagtgctgggattacaggcatgaaccaccgtgcccggcctttttttttttttttggtagatggagtctcgctctgtcgcccaggctggagtgtggtggcgtgatcttggctcactgcagcctccacctccctagttcaaacgattcttctgcttcagcctgctgagtagctgggattacaggcacctgccaccacgccctgctaatttctgtatttttagcagagatggggtttcactgtgttgcccaggctggtctcaaactcctgacctcaggtgatctgccctcctcggcctaccaaaatgttgggattacaggtgtgaaccaccacgcccggccagagtgtgtagcttttgtaaaagttttggaaatggcctcagataatttcagaggtttttaaataaagaacgctcaaaatggagcaaaatggagagcccctgataggcctcctgcgtggaggtttgcagtaagccagaggcacctgtgggtcccagggagagacgggctgctccatggatgctcctgggacctggggcactgggtgggcctcaggcagataggagctggtccgtatctcttgccaagcccaggccaactcctgatgaagcagattcctgtgggtgacaagtgtcagaagatagaataggaccttagggtcaggaaggatttcttgaacaaaaaaggggaaaaacagattgagagattcagaaagctgtaatatattctgtgacctcaaaggtgacttggaggagggctgttgttcagcgacgggcgtgtagtgaacactggggcatttaaacggttcagatgctgaatttaatgttatatgttttttactacaattggtaaaaaaaaaaaaaaaagcttgtgctcatcaaaagacacaccataataagtaaaaaaagaactgtgaactggaagatacttgtaacatttttaaccagtgaagggtcggtgtcctggatatgtccactgggcaccacagacagaacggccttgaaggtaggctggagacgcctacccttatcaggccaggcaagcactggggagcctggccgtaccagtcattgttgaggctgcaggaatggcagggagccctaagttccagtggccactggtgcagtcctcagagagcagttggcacaccgcctcaggctgagcctgcccattcttgggcacccagaagttccactcttaggtatacaccagaagaattcttcctcgactgtttgtgctgaaggacaaggtttaagtttttaaaatttccagtgtcacagactgatgatatttttgtaaactacaacaaaagtgactagctagtaaaggaaatcacagaacataaaatacaaacccatgtcattattattaatattttgaggcagagtctcgctttgtcactcagactggagggcagtggtgcgatctcggctcactgcaacctctgcctcctgggttcaagcgattttcctgcctcagcctcccaagtagctgggattacaggcgtgcaccaccatgcctggctaattatgcctggctaatttttgtatttttagtagagatggggttttgccgtgttggtcaggctggtctcaaactcctggcctcaagcaatctgcattcctcagcctccaaaagtgctaggattccgggcatgagccatcatgcctggttatcgggggaacccgcccccaatatttcaatgtaggttctttctattttccataagtgtcggccagctgagaaataaagagaaagagtacaaagagaggaattttacagctgggccccccgggtgacatcacatatcggtagggccgcgatgcccgcctgagccacaaaacaagcaagttttattaaggatttcagaaggggagggggtgcaagaacagggagtaggtcacaagatcacatgcttcaaagggcaaaaaggagaacaaagatcacaaggcaaagggcaaaagtggaactcctgataagggtctgtgttcagcggtgcatgtattgtcttgataaacatcttaaacaacagaaaacagggttccagagcagagaaccagtctgaccaaaaatttaccagggtggggtttcccaatcctagtaagcctgagggtactgcaggagaccagggcgtatttcagtccttatctcaaccacataagacaggcactcccagagcagccttctgtagacctccccccaggaatgcattcctttcccagagtattaattcttgctaggaaaagaatttagtgatatcttccctacttgcacgtccgcttataggctctctgcaagaagaaaaatatggctgtattttgcctgaccacacaggcagtcagaccttatggttgtcttcccttgttccctgaaaatcacgattattctgttctttttcaaggtgtactgatttcatattgttcaaacgcacgttttacagtttgtacagttaacacaattatagtggccctgaggtgatgtacatcctcagtttatgaagataacaggattaagagattaaagtaagacaggcttaagaaattatcaaagtattatttggaaactggtaaatgtccatgaaatcttcacaatttatgttcctttgccacagctccagccggtccatctgttcagggtccctgacttcccacaacacctggcttctattacttttttaaaattagcttttttctttttttcgagatggagtctcactctgttgcccaggctggaatacatggtgtgatcttggctcactgcagccgccgcctcctgggttcaagcgattctcttgcctcagcctctcgagtaactgggactgcaggtgcaatacaaaaaatgcagaacttttgtattttctgtagagatggggtttcgctgtgttgtccaggctggtctcaaactcctgagctcaagtgacatgcccaccttggcctctcaaagttctgggattataggcatgagccactgcatccagccttattattattatttttttttgagatggagtcttgctctgtcgcccaggctggagtgcagtggcgcgatctcggctcactgcaacctctgcctcccggattcaagcgattttcctgcctcagcctcctgagtagctgggactacaggcatgcgccatcacaccgaggtaatttttgtattttttggcagagacagggtttcaccatgttgaccaggctggtcttgaactcctgacctcaagccatctgcccaccttggcctcccaaagttctgggattattttttaagcagttttgataggtgtgtacctagtagtgctctgtggtttaatttgcatttcccagggagtgggggcactgcctgtcttctcacgcctcagttgcttgttgctgtgacggtcgcccactcctcctgccagtgtctgtgctgctcacggtagctgcatcagcttcacgctgtccgcccttcgccacccaccgcgcctgctgctcaggaatgttccaagcaacttggtggtaacagaagctgagaacagcccagatgtccttcggtgcaagagtggatggatcagttgtggtctattcacagaatagaatgtgaccacactggagatgaatgaattgtagctacaatctgcagtgtagacgaatcttaggaacgtaggcgtttcagaagcagatcaagccaggcacgatgctgtgtgcctatagtcccagctactcagagcctgaaggtgggagatcacttcagcctgggagtttgaggccagcctgggcaacatagcaagaccctgtctcaaaggaaaaaaaaagcagattacagaaaagtaaatccagtgctaggccgtatttttaagctcaaaaaattaaaactaattagcgtttagggataaacatgaggtaattttttagaagcaagagaatagcattgaatttaaggtatatatggggaaaatgaaacttccaagttattgataattttccagtttttaaattagagacgggatcatggtgtttatgcgtcataatttatatgttccatatattttttgttgtttttttgagacggagtctcgctctgtcacccatgctggagtgcagtggcgcgatctcggctcacggcaagctctacctcccaggtttacaccattctccgcctcagcctcccgagtagctgggactacaggcgcccaccaccatgcctggctaatgtttttgtatttttgtagagacggggtttcactgtgttagccaggatggtctcgatctcctgaccttgtgacccgcccgccttggcctcccaaagtgctgggattacaggcgtgagccaccacgcccggctgatatgttccatatatttctttctgtatttcacataatacatagtaaaatatttaaaacagaacaaaaatagacttccttttaagatgttttcatatctgttcttacaaagttggccacagtttttccccaacagtagtttgagttcagcagcagctcttttataaaacgtttgctgcacacactgagattgcacctggaagtacagaaataagaacacacgtattttattttatttttttacccctgaagatctttaagtcttctgaggagcatggacctgctagactgcaagctgctgcattctgaggagcagggacctgctaaactgcaagctgccgcaggcggagatttttgcctgtttggtttattttgttaccactgagtccccagctctgagaacagagcgaggcatgtgatcgatgcatcgtaactgttgagcaaatgaatgctgagctgtgatggcaccgacgtgtccggggagaggacgcacccggctgtgtggacatgtgcccagggcccaggacagcgccacggaagaggacacacccggctgtgtggacatgtgcccagggcccgggacagcgccacggaagaggacgcacccggctgtgtgcacatgtgcccagggcccgggacagcgccacggaagaggacgcacccggctgtgtgcacatgtgcccagggcccgggacagcgccacggaagaggacgcacccggctgtgtgcacatgtgcccagggcccgggacagcgccacggaagaggacgcacccggctgtgtggacatgtgcccagggcccgggacagcgccacggaagaggacgcacaggacagcgccacggaagaggacgcacccggctgtgtgcacatgtgcccagggcccgggacagcgccacggaagaggacgcacccggctgtgtgcacatgtgcccagggcccgggacagcgccatggaagaggacgcacccggctgtgtgcacatgtgcccagggcccgggacagcgccacggaagaggacgcacccggctgtgtgcacatgtgcccagggcccgggacagcgccacggaagaggatgcacccggctgtgtggacatgtgcccagggcccgggacagcgccacggaagaggacgcacccggctgtgtggacatgtgcccagggcccgggacagcgccacggaagaggacgcacccggctgtgtggacatgtgcccagggcccgggacagcgccacggaagaggacgcacaggacagcgccacggaagaggacgcacccggctgtgtggcaggggaggttcccaagagcaggctcagggctctggggtctgagtgagggctctccagccagcagggagcagggcagggtgttgaagagacggcaggtgcgtcaggggctgacgtgggacccggcactctgtgctctgtgtctgcccgggaacaggtagtcctgcgtcggaccgggaagtgtggtgggtgtggtgggggaaggggctggcgtcagcagggctctcgtccgccaacgtctggtggggatgcccgccatgcgggggcctcaggctacagccagggctgtgaaggagccgaggtcatagagtggctgccctggcgtagggagggaggacacgggtccccgccatttcagaagctcagcgtccctgcacgtgtgcggtcttgtctgcctaggcatgtgtgcgggccctggggctgctgccagcagaacggactgggatacgctggatttgtaaaacgtgaccctttttgtttgcttttaatttttaatttttatttatttatttatttttgagactgagtctgactctgtcacccaggctggagtgcagtggtgagatctcggctcactgcaacctccccctcgagggttcaagcgattctcctgcctcagcctcctgagtagctgggattacaggtgtgtgccaccacacccagttaattttgtatttttagtagagacaggttttctccatgttggtcaggctggtctcgaactcctggccacaagaagcaatccacctgcctcagcctcccaaagccttgtttgcttttttttattttgttttgttttgagacggagtttcactattgttacgcagactggagtgcaacggcacggtctcagctcgctgcaaactccacctcccgggttcaagtgattcttctacctcagcctcctgagtaggtgggattacaggcatgtgccatcacgcccggctaattttgcatttttagtagagatggggtttctccatgttggtcaggctggcctcaaactcctgacctcaggtgatccgccctcctcagcctcccaaagttttgggattacaagcttgagccaccgtgcccggccaccttgtttgctttttaaagataatgatgtcactaaaagagttctgactgaggccgggcctggtggctcacacctgtaatcccagcactttgggaggccgaggctggtggatcacgaggtgtggtgatcaagaccatcctggctaacacggtgaaaccccgtctctactaaaactgcaaaaaattagccgggcgtggtggcgggtgcctgtagtcccagctactcaggaggctgaggcagaagaatggcgtgaacccgggaggcggagcttgcagcaagccgagatagtgccactgcactccagcctgggagacagagcgagactccgtctcaaaaaaaaaaaaaaagagttctgactgaaggttggaacttagccctccagaaatgaagactgcgaataacgctgatggcagctcgtcacttgcagcaggttgcagcacgtgctgctcgtgtagctgcggctgcacaccaggcctctcctttaactgtgttataacctttctgttgacatgggatccccttgaaagttttttttttggagacagggtctcactctgtcacccaggctgacgtccagtggtgcaatttcagttcactgcaacctcctcctcccgggttcaagccatcctcctgcctcagcctcccaactagctgggattacagatgcacaccgtcacacccagctaatttttgtatttgtagtagagatgaggtttcaccacgttggccaggctggtctcaaactcttgatctcaggtgattcaaccacctcagcctcccaaagtgctggaattacaggcgtgagccaccactcccggcccccttgaaatttaaaccaagtttaggaagaatgaagttgtgaggtgctacttcaaacatcaggtggcaaactcccggactcattaccccaaggaaataggcagtccaggttggtggctcacgcctgtaatcccagcacttcgagaggccgaggcaggcgggtcacctgaggtcaggagttcaagactatcctggccaacatggtgaagcccatctgtactaaaaatacaaaaaaattagctgggtgtggtggcgcgcgcctgtaatcccagccacttggcaggctgaggcaggagaatcgcttgaacctgggtggtggagggtgcatggagccaagattgcaccattgcactccatccagtttgggtgacagagtgagactctgtctcaaaaaaaaaaaaaaaatagacatcagaaagggttggctcctgtgatctcggcactttggtgaccatgacccaaggcaggaggatcacttgagccaaggaattcaagatcagcctgagcaacatagaccccgtctctgcaaaaaatttctaaaaacttagctggcatggtggctcacgcctgtagtcccacctattcaggaggctgtgttgggaggatcacttgagtctgagaggttgaggctgccatgatcccttatcacaccactgcattccagcctgggtgacagagcaagaccctgtctccaaacaaacaaaaaagcaaaaaatggtgttttacctaggtatttaccatttccagtggtcttcattcctttctaaaaatctaggttttagccggacatggtggctcatgcctgtaatccccagcactttgggaggctgaggcgggtggctcacctgaggtcaggagttccagaccagcctagccaacatggcaaaacccaatctctactaaaaatacaaaaattagccaggcgtggtggtacgtgcctgtagtcccagctattcaggaggctacggcaggagaatcgcttgagcctggaaggtggaggttgcagtgagctgagattgcaccactgcactccagcctgggcaacagagtgagactctgtctcaaaaaagaaaaaaaaaagaataagtcacattttggtgaggagcagtggcttgcacctataatcctggcactttgggaggctgaggcaggaggatcacttgagaccagcctgggcaacaaagccagaccgtgtctctatagaaaattttaaagttagctgggcatggtggcacattcctgtagtcttagctgcttgggatgctgagaagggaggctttcttgagtccaggatttcaaggctgcagtgagccaagatcgcaccactgcactccagcctgggcaacagagaaaaaccttgtttctaaaaaaaaaaattaggctgggtagggtggctcacacctgtgatcccagcactttgggaggctgtagcaggcggattgcttgagtctgggagtttgagaccaacaagatcctgactctataaaaattttaaaaaatagctgggcgtggtattgcacacctgtagtcccagctactcaggaggctgaggtggggggatcagctgagcccaggaggtcaaggttgcagtgagctgaaatgtgaccactgcactccagcccgggcaataaagtcaggcggggaaaagaaagaatgagttaacattttctcagctttatgtgttgagtgattttggattctatcctgaaatggtaagaatgaaaagaaaatctgccaagtccatccgttcctacactctcactgcctccaagtcattctgcgctcttgagccagaacgacctggccgtttttaaaaatggagttttttgccttagtaattgacttgtgtaagagttctttattccacttgtgaattgttttttatacgtacataatgtaaatattttctccccttctgtgcctttcagtatgaatctatctgaactcgattctgctgttgtgtgtgtgtcttttcctcagtaccagatggtcttgattactgtagatatatagtatatgtcttgaaatcaatagggtaaattctctaacttttgttctttttattaatgttgctgtggctaatctgtctgctacatttccttatacatttaaaaaaatcagtatcagtttctgcaaaaaaaaatcctcttggattagggttaggcttctgtcaagtctacagatcagtttggggagaactgacttctttatatcgaggcttctaatccgtgaacatgaggaatctttttcttatctttagtatcttagcaatttgtggttttcaacgtacagatttcataggtcttgttatttctttttctttttttgaaacaaggtctcactgtgtcacccaggctacagtgtggtggcacgatcatggctcactgcagcctcgagcttctgggctcagccatcctcttatctcaacctcctgtgtcactaggaccacagacatgagccaccatgcctatttaacttaaaaacaaaaacaaaaaaccgggcacggtggctcatgcctgtaatcgcagcactttgggaggccgagggggggattgactgaggccaggagtccgtgaccagcctggacaacatggcaaaaccctgtctctaaaaatacaaaaattagctgggtgcagtggtgcgtgcctgtagtcccgtgcctgcggcatgggaatgggttgagcctgggaggcggaggttgcagtgagttgatgacttaggatttttcttctcggtcactttgcaagccggggacccctggccagtgatgccccacctgggccctgcttggccacactggcgtgccccaactcacctgtgttatagcttgtactgtgttcggccattcccgagctcatgtaccgcactcaagatcaaggatacactggacattgaagggtgaggagggcggagaagaactttattgagcagtgaaacagctttcagcggaccaggggatgcaggggtggttcccctacctgaaggcaggaaagtccgcctgtgtggctgggtctggggctttttatggactcaggatgcggagtgcttgcagagcttgctgatgggtttgtgagtatgcagaaaaggttaaagtgggcatgacagtgtagaaaaccaattataagaggccgggcacggtggctcacgcctgtaatcccagcactttaggaggctgaggcagacggatcacaaggtcaggagttcaagaccatcctggtcaatgtggtgaaaccccatctctactaaaaatacaaaaattacctgggcgtggttcgcgtgcctgtagtcccagtgacttgggaggctgaagcagaagaatcgcttgaacccgggaggcagagattgcagtgaactgaggtcacaccactgcactccagcctgggcaaacagagcgagactccacctcaaaaataaaaattaggaaagggtaggtatgtgtaaaataggtgaaggatggggatcaatcagaggaaagtgtggcaaacaggaaggcaagttcttcatctagtctgaggatttaacttgtagctcagctgtcaggctttaaactgtctttggcttggaggtgggtttcaccgggaacccgccccatctgcctggcattcagctgcctcctgccagtatcaccgagatcgcgtcaccgcactccagcctgggcaacaaagcgagactatctcaaaaccccatattgatgtcatttcctaaatatttggttaaaaaaaaaatctgggcctggaattttatctggttttttttttttttttttttgagacggagtctcgctgtgtcgcccaggctggagtgcagtggtgcgatctctgctcactgcaagctccgccttccgggttaacgtcattctcctgcctcagcctcccgagtagctgggactacaggtgcctgccaccacttccggctaatttttttgtatttttattagagatggggtttcactgtgttagccaggatggtctcaatctcctgatctcgtgatctgcccgccttggcctcccaaagtgctgggattacaggcgtgagccacggcgcctggccttctggggattttttattacaaatataactttattaacagatgcaggcctattcagattttctatttcatgtcagtcttggtaaattgtaattttcaagatatttgtccatttcatctaatttttctaatttcttggcatgaagttgttcgtattttatccttttcacgcctctaggatctgtagtgatgtctttcctcatgttgctcaaagaaccaactcttttggctttgttgaagttatctgtttgttttcatggatttctgttccttatgatttccttgcttgcatttatgttgggtttatcctgttactttgtagcttcctgaggcggagccttaggccttgattaacgtgttgtactagtcagcattctgcagaggaacgttgccattatctgtgtctctttctaaaggagatttgttatgaggaattggcccacgtcattatggagacggaatctcatgctctgccatttgctgaagattgaggaaagcagtgggataataacagtccaaggacaggaggagacacgtggccccgctcaggctggcaggcgagaaggaaaacccaggccaactcctcctcccacccctttctattcgggacccccgtggactgggacgacactcacctgcacagggcagcgcagttggcttcatggagcccccagctcaggtgctgctcttaccaagaaacaccctcccaggcacaccctgaagtcatgtttcatctgggtgccccacgatgcagcaaaggagacatgaaattaaccgtcatgtacactgtatttattattcaattcaaaacattttctaagttcccctgggatttcttctttgagctacatgttagccggaggtgtgttgttgaatatcaagagtatcttcctcctgggtttccagtttgtagctaagtcagggatagtgctgtgtgtgacctcattccattacgtttattgaaaccagcttgaagccctaacatgtggcttgtcttagtgtacagcattcagttaaaaacaatgtgtgttctctagatgttgggtgttctgtgactgtcacgtcatggtggttgattagttagaaacaatgtagaaacaatgtgtatttgccaggcgctgtggctcacacctataaccccagcactgtgggaggctgaggcaggcggatcacctgaggtcgggagttcagcctgaggtcgggaattcaagaccagcctggccaacatggagaaaccccatctctactaaaaataccaaaattagctgggtgtggtggcacatgcctgtaatcccagctactcctgtgtgaggctgaggcaggagcattgcttgaaccggggaggcggaggttgtggtgagccgagatcgtgccattgcactccagcctgggcaacaagagcaaaactgtccccccccccaaaaaagaaagaaagaaactgtgtgttctctagatgttgggtgttctgtgaagatcaggtcatggtggttgatagtgttgttcagaacatcgatgtttttcctgatttttggtctgttctgtcgatttctgagaaagtattaaaattaaagttgggtcttgcatttttatccattctgtcagtcccttactttaattggagttttttgtccactaacattgaatttaattgttgatatgtttggatttagatcttccaactaattttctatttgtttcctgtgttgagttactttttcatttttcttgtaactttttagcttatacctctttgcattttttatgcagaggttgctgtaaggattacaatatgcatgtttattttaattaattaatttattttgtttatttatatatttgtttttaaggaacagggtccctgtctcctgggctccagtgcagtggagtgatcatagctcactgcagcctcaaactcctgggctcaagcggtcctcccgcctcagcctcccaaaatgctgggactacaggtgtgagcccctgtgccggcccacagtacacagctgcagttcttcaggatctcttggggtggccgtattctgccgtctcacacttctccatgccatggcgtctgtctgtgcacgtggcaaactccacaaggcagtgttggattcttttgctttgaacggtcttatggaataaagtccatcagctctgcccttggtactttcatctatactttgtgatactttctttttattttttcttctagaatagcctaacatggcagaccagagacagcgctcactgtctacctctggggagtcattgtaccacgtccttgggttggacaagaacgcaacctcagatgacattaaaaagtcctatcggtaagtggacaagtgtggcccccacatccccccaggaagacacacatgccccgtgtggtttagtctgcattttaccaagaaccattgcacatactttatcctggccgactcagcgttgaactggtcacagctcggtaacacctttgtatgtgtaatgtgctccttatagcttaaagttatggtattcatgttctcttgccaacaaaaaatagcacttagtagaaactgacacactgtccacagttccatagggagtcagggtctgaacctgtttgaggcctcacaggagccgcagagcgctggcatggtcctgtggtctccttgttttagcacagtgatgacagagacccctcactctgttgtggccttctgattgagcttgaagaactgcactcttgggtacagtttcattgagtaacctgtaagagacaccatcactaatccagacaattcagatagtcctcctctcgtgtgctagcatcgtgtagttcataaaacacttcttaaagtgccatcattacgccccgccgtgcttaccgttcacttggcacttgtgcagttagcggctgggacaccagggctggccttggtgccgctgaacttagatgtgccgtggcactcacagcccttggggctccctcctctgaggctgggtcagggtgaggaggtttacctgaaacaaccgcggagcttgcttttgtccctggcccctgcagccctggagagtcggacagtgaggtggcctgggtggacctgccttccactgcacccggcagtgcgtgcgggtgggatggacgcggcggcgggtgcgggtggaacaaagtccagggtagagccaggacatggttttggtttgcaggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggtgagggcgagctgcctgccgtgcgggcacccgagtcactcctgccgtgcgggcacccgagtctctcctgccgtgcgggcacccgagtcactcctgccgtgcgggcacccgagtctctcctgccgtgcgggcacccgagtctctcctgccgtgcgggcacccgagtcactcctgccgtgcgggcgcccgagtcactcctgccgtgcgggcacccgagtctctcctgccatgtgggcacccgggtcactccacgcctgcagggttcccagcattgcagagcccatgcgttgatgccagcaactctacactcctgagaaaaggcttctgggcatatggagcctttctcctcacctgtgtgatgggcgaagctctgtcactggcttggtgtcctgcctggaacaagccatagcgtacagattgtcccagggaagagccgtgcggagccgccagggtttcttctgtaaatggctcccagtccttcgtgagacaggaggaaataagcctcgatgttacatccgcatttcttcgtttcctcgttttgttccaaatgtcatatatgaggccagagggttggaatcactgcatggcatttgtgagaagcctgtatttggctttgactggtcggcctcctcactagaatccttataaagtactttttatttagttaatgttagacagagtctcgctctgttgcccagactggagtgctgtggtgagatcctggctcactttaactttgaattcctgggttcaagtgatcctcccacttcagctccagaactgcaggagttgaggcgtgaaccactgtgcccagcctggaggctgctttgttttttttttgagacggagtctcgctctgtttcccaggctggagtgcagtggcgcgatcttggctcactgcaagctccacctcccgggttcacgccattctcctgcctctgcctcccgagtggctgggactacaggtgcccgccaccacgtccagctaattttttgtatttttagtagagacagggtttcaccgtgttagccaggatggtctcgatctcctgacctcgtgatccgccagcctcggcctcctggagtgctgggatgacaggcatgggccaccacgcccgtcttggaggctgcttttctttaagctgcgggtttctttctgtctctcctcctcccttcttcagttctttccttctgcttcctgtctggaaggcagtatccccacctggaacgcaccccctgccttctgctgagggcatttgggagtcctgcgcctccctctccaggggcctcggaggccatgcaacaccaccttcttctccccccaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggtgagtgcccgccccagggcccgtgtgtgtgtgtggggcagagccagaatgggccctgaatggtgtcaacctgtcttgtcaaacaggagggcactgacactgtgccgcgagtgtttgtggtggcagctgggactgttgaggtgtgaacgtggaccctgaggtaaagcaggcgcatagagctgtccccgccgtgacctgcggtagccgtagatcccagggactgcgaggcggggcagggcggcaggcagttggggcggggctgagggccgagggctggcggtgacccaaggcgacggaggaaagccgtgtggggtggaggtcagcgagtagcctctcccggtggagagtttgtccaggtgcccgaaagtcgctccacaggaccagcgttgggtgcgcgccaggctgtggccctcgtgcagtgccctgtgtgcttgcttttcagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaccccacgtatgtcttactcgctagtcccgcagatccctggttttggagagcagcagctgatctcagccctccacaccccttgcggctggaaccttgcttccctcctgcctggtccagatgtggataaatgccccctcctcttgattgtgttttcacctccgttttctaaataccaagactggagcaaagaggccaagcgtggtggctcatgcctataatcccagcactttgggaggccagtgtgggaggattgctttgagcccaggagttcaagaccaacctgggcaacagtgagatcgtgtctctacaaaaaagagtttaaaattatctgggtgtagccgtgcctgaggtcccagctcgtcaggagggaaatcacttgagcatgggaagtccacgctacagtgagctgtggtcacaccaccgaactccagcctgggtgacagagggagatcctgtcaacaaactaacaaaaactcagaataacgtaacaaacatcttgaaatcctctattctgacttaagaaaaacgaaggaagggccaggcatggtggctcacgcttgtaatccccagcactttgggaggccgaggtgggtggatcatgaggtcaggagatctgagaccatcctggccaacatggtgaaaccccgtctttactgaaaatacaaaaaaaattagctgagcgtggtggtgcgtgcctgtagtcccagctactcaagaggcttaggcaggagaatcgctagaacccgggaggtggaggttgcaacgcaccgagatcgtgccaccgctctccagcctgggtgggagagcgagactccgtctcaaaaaaaaaaaaaaatttgagtcagattttccattttaaaaaaatggcagcatccaagaccgttttgcgtctctccccatttccatcctctgcttccatagctttaaactctgtctaccactgtcaggtccagtaagacgtactattggtttatacctttttacataaattgtactacaccatagtactgagtacaccacctgccttatgagtttgtttgttttttttttttttgagatggagtctcgctctgtcacccaggctggagtgcagtggcgcgatcttggctcactgcaacctccgcctcctgggttcacgccatttaggaaaacgcatgcctcaccctcccgagtagctgggactacaggcgcccgccaccacgcctggctaattttttgtatttttagtggagatggggtttcaccgtgttagccaggatggtctcggatctcctgaccttgtgatctgcccacctcggcctcccaaagtgctgggattacaggcatgagccaccgcgcccggcctgtttttgtttttgagacggagtctttgtggcccaggctggagtgcagtggcacaatctcggctcactacaaccttcatctcctgggttgaagtgattcttgtgcctcagcctcctgagtagctgggattacaggcatgtgccaccacgcctggctaactttttgtatttagtagacggggtttcaccatgttggccagcctgatcttgaactccggacctcaggtaatccgcccgcctcggcctcccagggtgctgggattacaggcgtgagccactgcaccaggcctaagtttttcatttgatacagtagtagttaagaaatcaagccgtgtggttatattaggtctggttcattttagcttctgtacagaacagtcacgaattaatcacagtcggtcctgggcaaactgaccacaggtttttagtttctcactgtggaaacaaagctgcctgaatgtcgctgctgagttgtctcgggtgggatcgctgggagcgggatctggaagccttcccttgactggtggccccacactgccctgcaaagaggctccccatcttctcgctgccccttctagccttagcgttgtcagacgtttttttctggcttggtctttgaattttcttaattaagtagaatccacgtttattaagttcagttttttttttctttttcctttgagacagagtcttgctctgtcatccaggctggtgtgcaatggcgcgatctcggttcactgcagcttccgcctcctgcgttcaagcgattcttgtacctcagcctcccgagtagctgggactaaaggcgcgccaccacgcccagctaattttttgtatttttagtagagacgggggtttcaccatgttggccaggctggtctcgaacctatgtaggcctcccaaagtgctgggattacaggtgtgaggcagcgcgcccggcctatgttaagtattttatatatgggattcttacagagaaatgttaacagcaagccgagcactggacactgggtggcgggcagcaagacccttgccagggagggttgtcggccctgtttctcctggtccaggggaccgcggttaacaggcgctgcggcaaaactctccgtccgcccagcgccccaggaatctcctccgtctccaagacggggtcggaccaccctccccgctccccccggctatgccttccttgcgccccgctctccgtgaccgaggaacgccaggaagggaccacttctagcgccagccccgctgctcagggtcgggtggggggcggggccagcgcgggggcggggccggctcaggggcgtggtcactcggtggggcccagcgggacctggcctaccaggcggagcgggggctgggcaggggcgtggccaatcgggaccggtggggcgggcgagtggcgggagcgctgcacccgcagatgggccccccacgtggggaccagcgcccacccggcctggtcgcatgggcaatgggagaccccactgcagcgcaaggtctcgcggcatctgggaagaccggccttacgccgtccctcccttcgtcagcagacccctgtccaggatccgggatccggcataatcgaggtgccaggctccgaggacgccacgcttttggccgtggacttccacgcagaaagacactggcgcctgagaggacggggacgaccgtgtcccgtgtcagatgcgcctggcccacggctgagtccccagcatcagccctcagctccacggctgagccccgggaggctgattcagttatctgggcctctccggggcccgacgtgtgggcgccgcgcgtgcacctcctcttcctcagtaaaccacggcggcgactcctctcggggagcccggggggggcctgctcggaaagcagggtgggcaggacctaagggaacccacgcttgcgggcgtgggcacggcagagagcacgggatgcgggtgggcctccaggtctggaggggtgagcgaggcgggccctgagcagcagtggctccgggctcgtgggccccgggtggccccgcctccaagcgcaggcccccacttccgccctggtctgcctcctggctttgctgcctccagcgacttgtcctgacgggaaggaccctccccccccccaactgtggggaggaccctgatggtacaaatttgtgggtgggggcaaaacagcctgcctcttgtgagacccagagcaccagggggccctgtcccctccctaggtccaggccaggtggccaccaagctatgggttctaggggccccatctagcagagctaggagctgcagggcccagttctaccccttccttcatctggcacaagtgcaagactgggaatgcttggtcctgcaggggagaaggcagggccctcagctccctccctccctccccatgggagtctccacaaatgcatgcctcagccaggacacctctcctgtgctgtaaccaatcacaccttcatttttctaaagctttatttattttataaaatgcatagaataaattatactagtaacattttaaaaattaacatctttgtattcagcagtcctgggtcaggaggcaggaggagggtggtggggacgggatggctcactgggcagctaacccgtgtaggccacttcctcctcgtcactgccatcggggaccgcgtctgtcccaaagtagcggtcgccaaagttccctggaaaaaggggggggggggtccagtgtggtggggcctcccagggccacccaccctgccctcatgtgcggctgaagggcccgggcagcctcaccaatgcctgggatgatgcggaaaaggtcattgacccgcttgtccaccgccgtggtgatgattctcactcgcggaaatgcataggccactgagtgcacgcccatctctgccatgagcagcgacagcaaaaagatcttgtcctcaggcacgtcgtggtcctaccgagtgtattgggcaggtaaatcccacctctgcctgaacctgccccgcctacccagggctcactcaccaggagcacgcgcactgccatcatggccgccgcgcccgtggacacggtgcagtccatgaggatcacgtggtcatcgctgatgtccttgggcagcctcaggtagtggagctgcgggcagcaggggtcaggctgcaggtggggctccctgcgtccccttgctgtgagctccctctgccccctacccccgggctcatcaccccggctgcccccaggcacctcgggctccccggtaagctggttggtctggatgaggatggtgccgatgcgcacgtctttgcacacagcgcgcagcgcgggctccatggtttcaccggcgcgcagaatggacacaccggtgatctgcggggaggggaggctaagcgcccacatcccgccccagcagcctgtcccgcgcccaggtgtgcccaggcaggtacctgcttccccgcatagcacttgcccgcatagtcctgcccctgcggggtctgtacgacgcagtcctgtggggtgcagggtgaggactccggtgagcgcagggagctcgcaccggctccaagacccaccctccacctcgcgggctacgggctacgaacctgaaagggcaggaaggagagcgcgtgctcgatgagcagccgcatcagtctcttggagtagaagatgaactcgtcgcgactggtctccttgtccctgtggggccaacagttgagcgggagcacgcgcccggggccgccccgtccccaggtgggccctcacctgatgatggtgtgcatgccccgtacctgcggcgtgctcttcaggacgctcagcgtccggggcagcgggtggcactggtgtgccgaggccagcgcagccctggggacaaaccgatggggaacactcaagaagggggtcttttcccagagccctccctccccacaggacggctgtgcgtcactgtgaggggaacacacgggccaggcacagcacgaggtgcagagcgggcctgacttctgcctggggctgagctggggggagacgtcgccctacctgagctgtcaggcaaaggcgaaagatggcggcgaacaacggggcaagctcaccatcaggcagaaagctagcggggtaggctgtgagggcccctcccagtgcgggacccctcctgcgctaagaggaagcagaagtgggccgggcacagggcgggctcacacgtgctgataggtgtcataccccagaatgggtagcttgtccccagcctctccccgggggaactaaagctttgtggggtcaggccccgccctggctcctccccgaggtggtgcgcggcccctcaagagaggggggtggggggcaaagctggctcagtgtctcttggctgtcccgtcccgccccgctgcccaagcctggggatggccggggcagcagcaggtctaggagcgggcaggaaaagggcggggtggaggcaagaaagaggtgggacagggaggaggcaaagccggaaaggggcatgacaggggcagggaatggggcggggcaggaaagggggtgatgcaggggcaggaagaggaaagcgacaggccacagaattgggtgtggcaggggaaggaaagaggcagggcacggaattgggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccggaaatggggtgtggcagggcagaaaagaggcgtgacagcggcagggaaaggggcggggcaggagcaggaaagagggcctagcgggagcagcggggcaaggggctacgggaaggcgggtcacacagcagcaccacggagcacactgctcacatatcccaacgtagcttcctctgcttgccaggtgaagagcatgttcagggagggaacaaggcaggaaacgggggtttacagagagaaggaagagaacaaagagaaggctgcttagttggggagcagggcgttccccgcaggcctgaggaggagtgtgggcggtcaggcccccagccctgcctgaccctccctcctgcccccgaccaaggcttcctggggctgaaggaagtgagtgcagccacaggccaacacttccttggctgaccagacgacggaaaatgtgtctggctgcgttcaggtgtttttccaagtttgaaaccctggaaagtttttcctctcagaacaaaagcttcaggaggaacctgacgggacaagacctgcgggttcctaggccgaggagagggccaagcggagactcatgcaggcaccggaagctggacggctggtggacgggccctggaggcatttccaacatttggcaaactctttggagggctctgaatgtgagggctctccctccaggtggctcagtcaggagcctcccaacccacagaaggcagggagaagggcaggtcccttgtggctgacccccctgcatgcctgcccttggggagggacagtgggatgcggccccggcccagcccaagcttcttgctgcagttgcccagttcctgctggcagagctgtgcgggctgcgaggacagagctggggcaagcaggacccgggtgggtgggaggacaggcgcgaggccctccacctgcaaccagggaaagctgactggtccgtgaggctgggcacaggaggtacagcaggctccctggctgctgggacatgtctgtagtcactgccccagaggcctggcagtgctggctcaggaggacagctgtgctctctggggtcaaatcccatagacagactcaggagtcaggggagcctccagcaaagtctggccaggacagggtcaggactccgtgacgctgggcaagctacttcacgtctctgtgcctcagtgtcctcatctgccagcaaggggaggcagaagcagggctgggaccactccacaccaccccttctgtgactggggaagagccagctgcctggctggatcacagcccagaccccagagctccttggaggtgttggaagtgcctccatctgtgcagacagctgtgcaagtcttacctgacgctgagttcacgctgtggcagcaacacaggaagacacaagggaacggtggcgcgtcagtgaccagggcaggcggccaggccacccccacccaggaatggacatgctgcaggcccgcggggacacagccagccatggggggtggcaagcttctaatgcctgtaacctggggaccacctgggccagacctgcagttctgcgttggggcaatcagagccaggaccctgggctctgttctgcaggcctcaggccttcaacatcctggtagggagtgtgttcagagccactcaggctccaaggcccagccatagaatgcctcagggagcaggggacctctggtgggggtgtcgctcctggggtgaccccctgagaaagagaggagcctggcctggcgtgggactcagcagtgaaaccccacaatcctgggccagcaggtcatgcctgtcttcccaaaagctcaggctgggtgtgctgagcgggctgcaccctcggctgggtcctgagcacctgtacccccaccccagcttcctcagggaacccaggccctgcacagcacaacgggatggggtctgggctggacaatctgactggccaagcaggctcaggacactcagggctggcacctggcaggggacagtgaacgcagggggatgaggtgaccaggccactgggggtggtggcagcggagaagtgggtagaggggctgggggctaggccgtggggacgtgggaccccgctcacctcctccagctggctgtgcacgtgctgcacaatcaggtcgatggccaccgtgttgccgctccctggggcgggatgggggggcgggtgaccgggggctgggccgttggcctgcccgacacccacccaacaggcagcccagcaggctcacctctggggaccacgatgtctgccaggcgcatggtgggctggatgtactggtcgaaggagggcttgacaaacttgttgtactgcttgatgacaccctcgatgtcccggccgcgctcactgatgtcccggcgcagccgccgtaccaggcggatgtcggagtctgtgtccacaaagatcttcatgtccaggagctggtggagacagcgggccagtgagtggccagatgccagcagtgggcatggagacactgggaccagcccctgcactgaggccgcctggtccgtgggcctggccagagccacttccccagggcaccctggcaggtggggaggagtggggaggtgggggtgtctgcacctggtccgtgggcctggcccgagccacttccccagggcaccctggcaggtgggaaggagtggggaggtgggggtgtctggggatgcggtgctgcccgtcaggggcttaggtgaagaggcatggcatggtggctggctaaggaatcaggcaggaatggggctgggcacatgtgatctccttactttgcttggggtaacttgcaccaacacactggggaatgggggacgtggcgagtttagggtctgtccccatgctcagcacacagtagttggcccgtgaagaggccttgtggaggctgggggctgctatgtgccggatgatggagtcctctgggcctgtacaaggggcaggacctgggccctgggatcaggccaacctgagtcacactcagctgtgtcctgaaggcccccttgagctacagcaaaatctctcaaacacaccagccctgggtcctcacctgtccgtcaggaccacggcaagggacgagaacgccaaggacactccaggtatgcgcacaggcctcagccggtggagaggaaccactgcctcaggcagccacgctctgccttttggggccggcagatggacccagctgtggcatgcctggggttggggttggggtagggagtggctggcctaggcctatacagtgtggaggccttggggacagggcaggaggacgcacacctcatggacagggcggccagggctgagataccagcggggtgggtattcccggcgggtgcttacctccaacagtgtcttgtcagcaaaggccatgatgccctcaaagatgatgacgtttgcaccatacagtgttttctgtgaagaaacccaggagttgcggagcctggctcatgtgcctgcagccccccgaggccccctctgcagggccctggcctacccagtccttcttccggctgtgcgtggtgaagtcataaatgggcaccttgacactcttcccctgcttcagcttcttgagggtggaaatgatgaggtcgaagtcaaaggcatctgggtggtcgaagttgaagttgttgtgtgcggcctgttcctgctgctgctcagtcagcacctggtgggggaggctgtggagcagctgtgggcacagtagggccctcacccaatgccagcggacaggggctctaggcctcccaggagcagccacgctggggctgagaccagggacctacttttgcagggggtccagggtcagggagaggacaaaggggtcctcgggggagctgggcgggggcccaccttgtagaaggagtccatggacagcaagaccacccagggcacatccagggcctcgatgatcattctggccacagtggtcttcccagaggcactgccgcctcccaagcctgccggcgggagtggagaccctctgtgaggaacaggcaggctgccggcacagataggtcccagaggtgcccatcccgctgccgctgcctgcggttgcccggcttccttctcctgctccacaggcactggaggggagccggaggcaggcgtccggcagcaggtcccacccccccgctgctctcaccgatggcgaaggcctctttggattgcgtgccgtgttcattgtaccagggcggccgcccggcggtgtagatggtacgcttgcttgtacgcagcaggggaggctctgacttgcactggctggtggtccgcttccggggagagcgcccagtgcccacaggtggcaggagcctgtccagggactctgcattgctgctgcagagagggatgtactcggatgtggcccagagctgcccacctcccaggtacccgctggcatggccggcccacagggcaccccccccaccccctcaacaggcatggctgaggcgggcaggctcattgggggtacataagaactctgcctgggctgggcgtggtggctcatgcctgtaatcccagtactttgggaggccgaggcaggtggatcatttgaggtcaggagtttgagaccagcctggccaacatggtgaagacccgtctctactaaaaattaaaaaaaaaaaattacctgggtgcggtggtgggtgcctgtaatcccagctactagggaggctgaggcaggagaatggcttgaacccgggaggtggagattgcaatgagctatcgtgccactgcactccagtctgggtgacagagtgagactccacctcaaaaaaaaaaaaccctgcctcctgcctgcagctgggccacaggacacacagacccaagtgctcagcctggcacagggcctcagatcatcactgtccacacagcaaggacagaggaacagcaaacaaggacaagggaaggaggagaggcgctatcttggggccatgctcatcctgctgtgtggacaggcactggctgggccaggctctgtcccctaggggactcaaggtgggcctgtgaaaggcaggtgagaccccaaaatggaccacgttcccttgcaacccggcacactctctgggcagccaaatcgctgccatgctgaaggctgggtgcccaaggagacgtgagggcggcgtgtgggtggaggcgagaccagaccaggttgtgcgcacacaccgagggtgaggtccccagacaggaccaggctgaagggctcagggagagaggcagagggctcagccaggacctgattctcctgcagtgacagcaggcccagcacagtgcctcggcctggcctctctggctgtcagagtgccggatgggggaccctgcgctgggagccttattggaaccccattcattcttgctgtggcccctcctgggtccccaagacagaaacctccggcatctggcaaacaccagagaggaaagtgctgccacctgtctgggctgccgtgagcctgcccagggtaagggggagcccctaaagtctgcaagggggaaatcaacgggaggaagacacaggcctaggctgtgtggcatctacatgcactgcacgtgctggaccggcactcaggcgcctgccaacttctccgtcagtttacaacctcaagtgggcagggggccgtgactggccatggagccctgggaggggcagcctctggggaggctcaatatggccgagtgccctgctggggggttgggggggcatcaacgtggcgcctgcccagtctgttctgagaggctcagatgcagagcctggtgtgaagatgccatgagacaagacacaggtccggcagaaggcacttgtggccactgcccaggagacaccgagctggctgtggtggcctcagcaccatgtttcaggtctccctgggaagctctcaggggtcagcaccttggccctgcaggtcatggcccactcacatggggagcaactcagaaccacagtcactgtctgtgcagggcagagcccccgggggcaagagggaaagctccgcaaacggcaggaccgcctctttgtagcttcctgcagcggcacagtctgtccaccgcgctccggagttccacaggaaatggaacgctccacagatgccagttacgcccgaaaacgacacagaacacaggtgcggacagggaacggcatcctcagagcatggtcaggggagaaaagcaagctggaaggagagatgattccatctgtataaaatccaggaaacgaaggacgctcaccgccatgcgcctcggtgtgaggagggaggcgtgtgtgagagggaggggatgtgtgtgagagggagggggcgtgtgtgagagggaggggcgtgtgtgagagggaaggggcgtgtgtgagagggaggggcgtgtgtgagagggagggggtgtgtgtgagaccgagggggcgtgtaagggagggggtgtgtgtgagagggaagcgtgtgcacacaccagccctaaccatgatcactctctggccaccaagatttggaacagcaacttctgtcacatttgaatgtttttaaagcaggtgccactttgttgccataaaccaaaccgtagtctgtctttgaaggtggcatctccagcgtgggaacactgattcccacctgggcactcctccccgtgcacccgtgacacccacagccaggaggacagtgtccgtgtgcacacacagggggcagtggaaggagggagcccagcccgacacgtgacagctctcctgggcccagagaacagtgtggcagcatttaaagcagcaaagagacccgccgtctgcacctgacggggaaaacgcgctgtgcctctcctcagagacagacaggtctgcctgtttccatgccaccatcaggggagtgagcacggggaataatcagccaggcagcctcactcagcctcacctcggctccggagatcgttctggagctgagtggtgacgtcagcagcagggctgagcacaaacaacaaggccaggcgccaagacgaccaggcgagggcggcccgggggacagcaccactgcacggtgccctgaagggggagcaggtgccacggcacttccccgagaccgcatgcgggggctgcagctggaatgggacctgcaccccactcaggtctgcctgaagggctgtcagtcaagaaggaagacgggacccagcaaacagaagccacgacctcccagcggccctggacacacatgaccaacgcaccagcagtaaacaaaagggcctgcaagggtcacccccggggccacccctcccagcaggtggtgatggatggcccgcagctgtgcacagtggggcagtcctgcttaggttcagcagcaggttcccagcagacagaaacgctctggtggccctggaggccgtggtgggcagagaacaaatccaggcggcccctcccctctatgcctaaccccagcatctgcagggaatcacccactgtcttcaacctcagggaggaagccccgacacaatctgacttgcaaagaggctccccagcgaagctcccagcaccgcccttgcggctgcctgcacttccgccatgcaccctggattccgagggtgagcccgctaatgcacaaagctgggactaacttgagggacagacaccagacggcagaggccgggctggcaccgtgcctgctccccattggtagtctcctggtgctcagtcctctccagcaggagccttccaaccccgcatttgtgactcttcctcatcctactgaagtaacaaccccgtcaccgcagatccctcctgaggcacacgctgctgacagccaggcgctggcccttctgctgggagtggtgcccatgcagcggaacggtcacaagcaggccaggacgatctgccagaagcccgcctcaccgcaggcctgtgacggcgtcaggctgagtctgcaccgagcccagccccactaccttctccaaagctggtctgtctcagagccaaggacaaagcctcaccccacggttcacaagcagcaccccttgacaggaaagttggccgggtgtggtggctcatgccttgaacagtcctttggaggctgcagtgggaggactgcttgaggtcagcagttcgtgaccagcctgggcaacatggtgagacggtctccacacaaaaaactttagaatattaaaaataaataaaaacagaggagaaagttgcacagcaaacctcacttcctgtgcacagatggacaggagtgcttctggccacaacaacaaaaggttaattccaacccggagggttccaagccgtaaccaacacaagagagacgcgcccagaccaacagcctcaagcaaaatggcaccttcgaccctgggctctgcccggtgcccgagagcacctgccagcctgtttgattcctgatatccacagacatgcaccaaacacaggtctgagtggccaggaccacagcacaagtgggtgcccctcacggcagagacctccagtcgagactcacctgccttctgctccaagggcccggcaccctgagatcctgatgccagggtaagctggggggctgctcatggtcgaggacacgggtgggtgctcctgaacagcagagtggccccaggggtggatgcgtgggggctcaggcgcaggcagccgtgggggacatcaccacctcagacccacagcagtcccctagggcagctcaggagctccggccacctgaactggcccttccatgggcaggaccactcctgtgggcagcacagtgggtgcagagccgggtggctggggtgagacccttggctggcagaagctgcctgccaaatgtcagcagaggcacagcagctaggaggcccttgaagcctccaccgtactgagggaacagcactcactgccgtcctcagaggccaaggccacaggcataagaggatcacccagctgggggcttgtgtatgcctgatattaatagcgctggctttgcctggtgtggccctgacaatcctcgggccagccctcggtgtgaactgccccctcctgtgtgtgggctggcacattcggccagcctaggaccgcaggcctgcggaggaccactgtgcgccgtgtgcctgcacccctcctggatcccctggaaaaagctacagtaccccggcctgcctggggctacagagtgaaccccccgcagcaggacaaggatatctgaggcgcctcttggccaggtgtcctgaacgtcagtgctgagctgggcaccccatccctagccccagagtgcttccgacaggcataaacaaatctgaaactccaccctctggcaccatctgaaaataactgccttgccctacccccactcacgggggatcctgcagggacctgcagccacccagggctcaccacccagggctcagcagagcacaggggacacagccacctccccgcccagggctcagcagggcacaggggacacagccacctccccgcccagggctcagcagggcacaggggacacagccacctccccgcccagggctcagcagggcacaggggacacagccacctccccgcccacagaaacagggtttcggccccaccctccgcagagtcagtcaaggatgtgcacagagaagtcctggcagccctaagctctctcccaggggcagacaggtcagccatgggtgtcagcttcctcctaccatgggtttctcttggagcttctagtactgaggcaggggctgccagaagctcagggaaaagggaagactccacatggaggtcatactcctcaatagtaggccactcctgggagctgcctcagaggcaggaccggcccatctgtctgtgtccacaggtgcttcctctcctcattctgctcccaggaggcggctacatccctcacttgggaagtgggcaggagacagcccagggtcggggaggcggaggctgtcctgagcaggggcgcagagtccgggctcctgggggccatgccactggctgggctgtctgaacagcagagtggacgcagactggtcttgcctggcatgggcatgcaccctggctgccctagccggccaagaggcaaggctacaggcctggggaagccagcactgtgctggccaggcgagggacggaggagcccaggcacgcagctgtgaatggaaccaccaggccccaccctggaatcacgtcgcctcgctgcaggccacgtggtccccaacatgcccctccacggggctgctctcggccacagcagcccacggcagggaggggccgctcacggtggggaggggtagcctgccctggtcctattcactggtgttcctcccaggttctaacttcctgagctgggccggtccagagaactcccattcccacgccacccacaggtgctgatgccgcgctggggtaagcgctgcccagagcaccttctgcctaaggcttcctccttgcaggtggggctgtctgaggcccgtggtgctggaggctgcctcagtcacttcagggcaccccttgcccttccctcaccttcagccatcctactctgggccacagcacagtcgaatgtggctcagtcccctccacggagccacagcttgcctcagtttcctcctcaaggactaacagcaggttcattacaggtgggtcagctcataaagtccaaggcagatgcctcatcggtgatcaggccccataactgatgtcatcgtcaagaaataggcacaggtggccgggcgcggtggctcacgcctgtcatcccagcactgtgggaggccgaggcgggcggatcacccaaggtcggagtttgagaccagcctcaacgtggagaaaccttatctctactagaaatacaaaattagctgggcacggtggcacatgcctgtaatcccagcactttgggaggccaaggcaggtggatcacctgaggttgggcgtttgagaccagcctgaccaacatggagaaaccctgtctctactaaaaacacaaaattagccgggcgtagtggcacatgcctgtaatcccagctacttgggaggctgaggcaggagaattgcttgaacccgggaggcagaggttgctgtgagctgagattgcgccactgcaatccagcctgggcaacaagagcaaaactccatctcaaaaacaaaacaaaacaaaacaaaagaaatacacacaggcagccgggtgcagtggctcacgcctgtaatcccagcactttcagaggctgagcgggcagatcatctgaggtcaggagttcaagaccagcctggccaacatggtgaaaccccgtctctactaaaaatacaaaaaattagctgggcgtggtggcgggcgcctgtagtcccagctactcgggaggctgaggcaggagaactgcttgaacccgggaggcggaggttgcagtgagccgagatggtgccattgcactccagcccaggactctatctccaaaaaaaaaagaaaggaagaaaaataagcacaggcatgtgtggagacctggaggcagggctgcccctcacgaaccatccacaatgccaaggaaaccagaagcaaacgtccagcagcagggagcgcagggcatgtgaaaccgacactgaggaaacagccacgggagagagcacacagggagaaaggaaggctcgggcactcccttgctgtggttcaggcctgttctaccacccctggggtcaccatcgcccacggaccttcctgctgggtgcctgtagcacggcacctcctgacaggtcaggtttaagggaagtttgctggataactaaaatgaggctggggggaggagggagcagggaggagctagcccacaggagccaatgcaggcctgaccccactggtgccggactgactcagggagagtcattagggctgctttctcaggctggatgagcactgggggttgggggcttgccctggcccaccccaccactcaggaaaccttccctcagcaggacctgccctgcacagatcatgggcagcctccctctgctccccacttccacagccccagactccatctcaaccgcagccaggagtcactgctaacaccacaaaggacctgttcctgcaccagcacgggccagctctgggggcaggtgcccaggacagagtcacgagtggcaagcagacaataaacaacaggcaagatggacagactgattgccgggaggatgtggcaggaggcactggaacggtggtggaggaaccccagccctggggacagacctccacccgtgcacagacctccaagctggagcctgctctggaacactaagggcagcagcagaggttgaagaggggcagacgcaggaacgttggggacacgctcggggaacagtgagaaaagccctaggctggggcagaggaagtcctcgatggcacaagcatcaggacacaaagtgcaagaaatgtgcctaagacaagaggcagttccagggcagaccggggcccctggagaagggtgctgcaatctatcctcactgcctggagcttccctcctgtcccttggtaaccacaccaaagaaagataacaacagtctctgcctcgtgggacacagcgagggccaccgtgcccagcccaccgtctgtgcacagggcaggcccagatggctgctgccaccaacctgtgtcatccaggagtgcctttctcaagagctctcagtgcttatctagcgttggcctgccccacctcgggttaaatcaaaacctctttggtggctgggcgcggtggctcacgcctgtaatcccacggaggccgaggcgggcagatcacctgaggtcaggagttggagaccagcctggacaacctgacaaaatacctctctactaaaaatacaaaaaaaaattagccgggcgtggtggcgcacacctgtaattccagctactcgggaggctgaggcaggagaattgcttgaactgagctcgggaaagggaggttgcagtgagccgagatcgagccactgcactccagcctgggcgacagagtgagactccatctcaaaacaaaaaaacaacgcctctttggaaccagcagaggaacagactcaggccctattagactccagccatgcaaagttcctagtcactgcccactgggagggtgtggacctgaagggacgcagggccaggggaaagctctttctgctcagcagctcctggagaggagcgaccctgtgccgggacacccttccccctgcggcatccagcgcagcccatctctgagggagtcctggctcacagcgtttctgacaggagtcacagcctgaacccaggcaagaggcgcctgagtgggaacaaccccttcctggggaccccgcgggctccccaagggacacttcagacccggaagggaggggcagcgcccagagcgccctcttgcagccccgggcactgcgtggccaccgccccctgacggccacggccccaaaggcgccgcgcagggcccggctcccagaggggccactcggggtgacgaaccggggtgggggcgggttcctcccgctgcacccccacaacttccccacttcatgctcttgcaaagcccccgcagaggctcgaaggtgccacgcgcgtgcgaggcaatccgaaggcaccgtgcgccgcagcacctccaaatcctaagccctggcctcgcgggtcgggcagggccacaccccgagccgacaacatagaccaactcgcacagtcgagcaggcacacagcccgccgggcgctcgaggccgagggccccacccaccgggggcagagaccaaggtcaacgctgggggtgcgcacccggactccttccccgagccccgaggagcctgccggcttgggccaggtccgtcctcccggccgcttcaagcccgcggggttccacccggcacgtgggagaacggggcgccgccgcctggcctccgggagtgggggacttgggctcgcggcggggacggaccacccgcccagctcggccggatctgcagccccttcccgctcgccagtggagtggaggcgaggcccacgcctaccggtcctcgcacgcggtctcgcttttctcagcctgccggcctggtgtgtctcgggccgtaggtggcgacgtgggcgaaggatcagcgtccgcgcgggccgggggcgcagccatggcgctcggaggcctctttgcgggcctggccgggcggcgcgcatgggccgccgggagctggcgggtccctctcttgcccaccgcggactacaagccccacaaggccgcgcgtcgcggactacaagccccacaaggccgcgcgtcgcggactacaagccccacaaggccgcgcgtcgcggactacaagccccacaaggccgcgcgtcgcggactacaagccccacaaggccgcgcggcgggcatgggggacccgtagttcggcagcctccgccacgtgcctggagggccccgccccctgtttttcaccacaaactgagccgcacaaaaaccctggaaaaaaatcaataaacatttatttgatacagtcattttaatacatacagtgatggcccgtccccacgccactcgggaccagggcgcggggcggggacgaggaccggggacagatggtcacaaggcgggcggggcccgaactcaccgttgaaacatctcgcaaataaacactttgtagatagaatatatatgtatatatatatggttacaagtgatagctggaacctctttcaaaatgcacttatgtactgagaactggcattaaaaaacccaaaccaagaaacccaaagcacgggacgcccggccgcgaggcaggggaaagcctggggccccagacccgggcctgggggagccgcctggggccccgccaaacgcggcacacggggacggcccctcccggggtcaggctcactggctccttcccttcagcgccaccaggcaggagggccaacggtcacacaggaggcaccctcacctgcctttgcaccagcaaataaagtgcatcccattttcgtgtgagcgtcggcccggtgagtcagcccttccgggccctttcctgttctcagggcagggggcgtgcgctgagccagaggtagatctgcagaaagggccccgactgggcctcgggcagggccggcgcccaccacactctgggggtcagctatgctggtccctctcactgagggctcctggaggcctatgtgggccagcgtagggagtgggcagaccctgctgagctccacccagggccccaccccttgggaggagggctctgcggaccagcatgtggcagagggagggcagaaaggagggggtcagacccaacagccacttctggcagtagcccccacgcctaccttaaagacaaagggggttaaagtgctaaacatcaaggtatccaggactcctcttcccacaccagggattatctgtgggctttgggagtgtcccggaaactcacccccagcaaaaaccagaccctcttctcttctccccaagggccaagtacctgagaggctggggcaggcaccacaccctgcaggtgttcaggtccaccctcctcccgccattggtggcaaggacaaagtgcacctaggcccccgcccagtgcctgctcccctcccctcccctcccctcccctcatgaggctgccccagcagcagctgccagaccccaccctccacctccggctcctccagctccaccagtgaagctctgggacacaggaaggaatgcctcccccgaccctctgacgctgggtcacgcccatctctgccccagcctccatcctctcatcaggccgaggtgtgcgtgggtggggggagtccgggtctccacacccactccctggcacatctggcaagggctgctgagggttggagccttctggcccaaggatgaagccagagacaggaagtgttctgcaaccccagtccccaaagtgctcctggaacttgtctccctactactgcaggccaagcccagtggggccccttctccctggggaatgggggagggtgggtgctgggggcagaggcagtgcccagtcagtactgcctccctgagcagcaagggaccccaaccccagagacccacgccctggtccagcccagcccccaggcccaccgtctgcaccaggaaacccttagcaccaaatgtcggattgcgagtgtttgtataaaaaacaatttaaaaaaaaggttgttacttgtcacagcaacaagactggcatccactacacccaggagacacacgcacacgggcaaacatcaaaattctcatcgtccagggtcagtggggccgagccctcagcccactcccacccaccctggaaaatggcctccctccaaacctaccccctctgagcctcatcctccctgcaatgccgtggttggaaggcaggaccccagggagggagccacaggctgtggccacctcttccaggcaccctggactccctgcctgacccctgccctacctatagacccagccgtcctcagggccacaaaggggcaaagacagctctggagctgccatcaacctgctgtgactttggccaagcccctcccctggctggccttcagttcccatatcaaatgaccacacaaccagaaacaatgggggcaggttaaaaaaaaaagtggggagggggctcccatgagagcttggccactgggcctacccagattggcagacagaaggctgcctttcccccagtggccactcagagccaggccagctctgcccagcttcctgccccacatgcctatgggccccagcaagaccccagggcccgaactagtccgtccctactccacgaggctgctccaacctaggcctgcagtgccagaaggctgaacactggaggagagcacactccaggggccccacacccccagggctggcagctgtgttgaagggcatcaagcttctgctgccctgtaggtacaagaagcaaaacccctcccttgccccaagctgggagaattacagacaggcctggggggcagggcctgagcacagcagggatcgcactgacaaaggaggagcaggggtgggggtagtgggcaggcctggagaggtagaaaacagaagcaaggggaccaagtgggtggccaagggcaggccggagcctgtcaggtcagcatggcagtggtcagacaggggtctgtcctgggaggtagctgggggtgctggagttccagtgttgggtggaggtgaggccaggatggtggctgcccgtgccaggttgctcaggtgccctcaccagcccagaaccacaggtcaccagggatgcctgagccttggggtagccagggaagggacccggcagggcctgaggaagcggagccggggggccaaaggccatctgcctactctgcgctgcagcccctgtggcaccaagaccccagacacattcccatgaggaggggcaaccctcctggctattgcacttctgctgggcacaccttggggagccccaacccaggtgtgccctgtggcagccttaacaggggaagggccaccttcagggaagggagagtggctggctgccccactggacggatgaagaggcgggggtgggggatggagaactggaggacagaggtcccggagctggccctgccttgaacagagggcggtgtggcggctgcatgggggccaggccccacgcaccatgctcacttttcaggcgccttgctgactcccaccttccggccggtggagccccgggcccccttgtctctgcatcctggaggccagtcgtcccggcgcgggggcagcttggccacaggctcctctggggtccgctccttgggctttcggccccgcttctttccacctgccagatttttcttcttttccttcttgggcaccaatgagtcctggctcctgtgtttgggaggtgggtctgctgatgttcggaaccagttctggggagagaaaagcgctgatgaagacctgggactggatgctgagcacctgagccaggcatagcctgagagctgaagacctgtcagccttcaggaccaggcaagcacctgcagcagggctggacacagcctttaggaccaggcaggcacctgcagcagggggctgaacacagccttcgggaccaggcaagcacctgcagggggctggacacagccttcgggaccaggcaagcacctgcagcagggctggacacagccttcgggaccaggcaagcacctgcagcagggctggacacagccttctggaccaggcaagcacctgcagcagggggctggacacagccttcaggaccaggcaggcacctgccgcagggctggacacagccttcaggaccaggcaggcacctgccgcagggctggacacagccttcaggaccaggcaggcacctgccgcagggctggacacagccttcaggaccaggcaggcacctgccgcagggctggacacagccttcgggaccaggcaggcacctgcagcagggggctggacacagccttcgggaccaggcaagcacctgcagggggctggacacagccttcgggaccaggcaagcacctgcagcagggctggacacagccttcaggaccaggcaagcacctgcagcagggctggacacagccttcaggaccaggcaagcacctgcagggagctggacacagccttcaggaccaggcaagcacctgcagcagggggctggacacagccttcaggaccaggcaagcacctgcagcagggggctggacacagccttcgggaccaggcaagcacctgcagggggctggacacagccttcgggaccaggcaagcacctgcagcagggctggacacagccttcgggaccaggcaagcacctgcagcagggctgctgggggctggaaaggcggacaccccgagggcagctccagctcagggtgcaagcctcccagttctcccagggaagccagaccccactttgaggagaaactaccagatttctccacattggccactctcccaggcacaccccatgcaggccactgacctctctacccccaaggggtgcccaaccccagccctgtcccctcctgggctagcccccagccacaggccctggtgatggccctcgcacctctgcgtgggtcttcaggatgtggtatttgacgccactctcagaactgaactccttcggacacagcagacagcggtacttccctgccaggtgggccccctgcaatgcataggcaggccagtgccccagcccttggaggacccagatctgtcctaagcccctactcatggctaaagggtcagagtcagcggtggcccaaggaaagctgtggctgtctgtgccagacaatgcagggggccactgagttaccagggcggcaggggtggtaggggagaggaagggtagggagaggcaggtgcccaggggaagagttgcagacctttgccgagcatcccttattgtaagccagtgtgccatctgcgtgggtcggggtgcccacccatgcctacatggacgcagagctccaaggacaggactaggactcgttgtcttgtggctggggttggggcgagggaggtgtcctaggctggccatcagccaccggccagtctctgggttcgtggaagaggaggccacgtagaaaaagtaggggacaaggcagggtccctcactactgtgtgggaagcccgcgtggggtgagctgggagctctgagtgcagcgcacctggccgtggggcaggccccagaactgaccttactgcagctggcgagatgagccttgagtccggacacgctggagtagatggcttcacagcactgcagggaagggagccgtgggcgaaggcctctggtgggcaccccacaccaagatatacccctgccctaccccaggggatctctgaggctctttggggcaagtgagggggtgtgagtcctggggactgggcaggctgggcatgtgaggcctggggtgggcttgggcacctcctgaaagctctcagcctctgttcctgctcagagggccacacccaggctctggccctgtatggctccccacgccccccacccggctgcctccgctcacgtcgttgggacagttgacgtggcctttctccttcacttcattcttccatgcctctagcagctgggggttcagcgtggggagccctggtcgagtgtagttgagctgtgaattcgacagcaccagggtgagcctgaggccagaagacaccccagctgctctaagaacactcgcctcggcagcaggcgacactcgccgcagatggcgggggcagcgggtggcccaggtcacagcagtggctgtcccaagtctcaggccaaggcatgccccacgcagaggccacggcgctgtccacagccctggggggggcagctcacccgtgcggtctcgggcacaaggtcatccttcatgcgccgcttggtccagtcgcgggccagctcgtcctccgctatctcctgcaggtggaacaccgccacctgggccgacgtgcggcggacacgcccgcttggggtccgctccacacccagcgggtcctcagcctcaggggacttgtctgtgggctcctcagggggctggagggcaggaaggcatggaggctagagtgagccgcgggagcaagagtcaggtcagcgcgcggcgaggccaccctaaggccggtggacccacaggcctcccagtgtgctggggacatggctgacgcaggcaacccgagggaacacggaggtttcaccctcccgcccaccaggacacacgtctcttacagagaggggtgggaaacacacgcgttgggcggtacatggacaaatacagttggcacccaaggcacacggaacacacacggcacacaggaacaagcactgtgccacagaacagagagccactcacgggggccgtgtgctccgagcgcacgtggtagtcgtggccagccttggatcggtacgtcttgccacagtgggtgcaggggaaggaggggctgtccacctcgcagggcggcttcccgcagcgccgctggtggtactggtagcccatgaggctggagaaggcagccccgcaaccctgggggtcaggccagagggtgggtgagtggccagcagggcccccccaccccacactgccgcggccccccactgacctcctgggggcagcgcagccgtcccatctgcttcagcaccttgcgcagcctctcgcgctcctcctgctcgcccccttcggaggcctcggcgtcagagggctggggacagggtgagcatcggtgacccggcaccatcgccacggagccctgccctggccccgccccgcccaggtgttgggccaccgttgtccgaggttagaaaccgggggcactgcggtgaaggtggggtgcgaggtcagaggtcacgctggacgggagctgggggcccgacggtaccttggcactgtgctcggccatagtgtggtagttgaggccggctttggacttgaactgcttccggcagtgctggcacttgagtgcatcctgaagctgcagatggcccacatgtgagaagcctgcctggggccagggcgcctccctcccagcgccttccgggagctgccttaccttctgacacacctccatgtgcttcttaagccccacgagagtcttccgggtgaccacgttgcaggtggggcagacggcttccccgcgctcatggatggccctctgccactgctcttcagggccacctgtgggtaaggcaggggcctcgaaggcttgtgggggctgctgggtggcccagacgccaggcacagaatccagtctccacactcagcccccatccctgtgctgtgggatctacccgccgtctagagctgccctgagcccctgccaggcagcccctacctggagctgggtgggccacaggggccggtgcctccttgctgacagtgatgggggcagctggcaccttcttccgggcgtcctcagggcctggcccctcctgcttcttggagcggtgaactcgggccttgtcctcagctttgaccaggcctgtgtgcacacatggggtggagagaaacagggatgggctcaggggctgtcactcggtggacagccccagccctggaggtgcacaccgggctggggtcttacctttgagcccaaaggtccctgagatggatggctgctcccctgtaaactttttgggtgttttctgtttccttcctgactcggggagagaaaacgggggccaagattctggtgaaataaccgtcaggaggccgagcctgccccggccgccacccctggagctctcatcttactgtgctttgtgcgctccgggtcctcctcaggcggggacgcagggcctgcagccttcagtgcctccatgccccctgacggcctgctgcctggcgacaaggagccactgctggtgtctgcactcagctggaaggccgagctctggcccatggaggaggggccgtactccccattctctggcctggcctgcttgggtggaattgggcaggtgtccaggctgtccgcagccctgcagggagcaggtgaggtgagggccaggagggcctaactgtgggccccattacccccaggccgtggccgaggagcaccctgacctggaacgagcccccataccttttctcaccactgttccccgacctgggacaagcccccataccttttcttaccactgttccctgacctgggacgagcccccataccttttctcaccactgttccctgacctgggacgagcccccataccttttctcaccactgttccccgacctgggacgagcccccataccttttctcaccactgttccctgacctgggacgagcccccataccttttctcaccactgttcctccccgacctgggacgagcccccataccttttctcaccactgttccccgacctgggacgagcccccataccttttctcaccactgttccctgacctggaacgagcccccataccttttctcaccactgttccccgacctgggacgagcccccataccttttctcaccactgttccccgacctgggacgagcccccataccttttctcaccactgttccccgacctgggacgagcccccataccttttctcaccactgttccccgacctgggacgagcccccataccttttctcaccactgttccccgacctgggacgagcccccataccttttctcaccactgttccctgacctgggacgagcccccataccttttctcaccactgttccccgacctgggacgagcccccataccttttcttaccactgttccccgacctgggacgagcccccataccttttcttaccactgttcctccccgacctgggacgagcccccataccttttctcaccactgttcctccccaacctgggacgagcccccataccttttctcaccactgttcctccccgacctgggacgagcccccataccttttctcaccactgttccctgacctgggacgagcccccataccttttcttaccactgttcctccccgacctgggacgagcccccataccttttcttaccactgttcctccccgacctgggacgagcccccataccttttcttaccactgttcctccccgacctgggacgagcccccataccttttcttaccactgttccccgacctgggacgagcccccataccttttctcaccactgttccctgacctgggacgagcccccataccttttcttaccactgttccctgacctgggacgagcccccataccttttctcaccactgttcctccccgacctgggacgagcccccataccttttctcaccactgttccccgacctgggacgagcccccataccttttcttaccactgttcctccctgacctgggacgagcccccataccttttcttaccactgttcctccccgacctgggacgagcccccataccttttcttaccactgttcctccctgtggcacgaggtgctttgttctccgacctggtcagcagcaccattttgcagggcggtgtgtgtctgctgatagcaatgggcctgctgactgtcaccggcttgctgaccacaatgggcctgctgactgtcactggcttggtgaccggcacgggtttcgtaactgtcacaagctttgttaccgtaatgggtttggtgacaggtacgggtttggtgaccggcacagacttggtgactgtgatgggtttggtgaccggcatggccttggtgacgggcatgggcctgctgactgtgacaggtttggtgactggcacgggcctagtgaccgggatggccttggtgactggcatgggtctgccgaccgagactggcttgctgatgccaatgggtttgctgacacccacaggtttgccaatagtgacaggtttgctcactccgatgggcttgctgaccccaacaggccggctgatggtgaccggcctgctgatgggcccaggcttggaggcaggcaggggtcggtccatgtggttccagatccggtgtttctccagctgggtcttagaggtgaatgcggcctcgcagaaggggcaggggaaggccaggcgatctgagatggcaccctgggcagggaagggaaggtttgggacagggccccaagggcctctgcccaaacacaccccgaggcctcctctcccccgacccacagtcccttaccccttggcaccgctggtaatggtacttgagcccgtagatgctggggaactccagccagcaccctgagtttggacacttcaccctcgagtgtgccttgaactcatccttccagtcgttcatcagggagagctaggcgtggggaaaggtggtgctgctgacccgcagccacctgggccactgccagcccgagccccagactcagagcccccccgggcctgcagggcacacacaccacatgagcccctcaacctcgggactgcagtgggaattcaagccacctggcaggggccatgcacaagacccgttctaggagcccaccaacgcgatcccccgaatctcccggcacatcagatacaaagccaggccacgtgaagtctgccaggccagtgcccacatcttgaggcatagagttggtaccagatgtgcagaggacaaatcagggcagggcagtggctggatagggagaccccagcatgagccccaccatggccctgagggagctcacaggaatgtctcggagggcctggttctcggcttttggccgcccctttttcttcccttctgtcttgtcactggctggacttcccgggtcaaagcagagaggggcctggccgggcactgtctgtccaccacggaccaccggcatccctgcagcacacaacacagcaaggctcggaagctgtgtagcaccgcctaccaccggcggctgcacaggcccacagtgagcaccgctgtcccaacacgagggcaccgggggcaggggctgcggccagctgaggacaagaacccaggaccctgggctatgtccaaggcaacccctaccctggtaaggtccttgggaactctaggggcctagctgggtacctggagacaggacgcccagggcaatggtccactcctaccacttgctgcccagaaccatctggaattgactctggccctgactcctcttacccatcttcggtgggtcatgcagcattggaagtcggacctcctttcggctgccatccttcccgggaccactcttgctggaccccgggagccgacggcctccaacgcagaaaggatccgtcatctctgcagagcaagtagacaatctgtgaagcctgacgggccccacttggaacacgtggtgaggctgccctggagccctgcccttggcaggtcctctctggtcagggaagaggggcctgccttcctgtggttttgttcacgtgggaaaagcaagtgatgggggcttctgacttaggggaggggctgccagccaaggtctccccagataacccaggagtcatcatcagtttgataggatctagtcctgtcctgagaccctcaccaacttccagacccccttcccaacacgcagctctacagtgtacgcagctccacagtgtgcgtagccccacagctgcgaagatgatgccgaaggtgatgcactcctacccagtgctgggagggggtgtgcccctgggagaggtgccttgcgcaggaggaaggaggctggcaacattcctccaggggccaattatgtctctgatgatggctgctggctcacaagctgcccaggcccagcagtgggggcacagcttctcactggggccctcataccttcccatgctgacttgatgcaatgccagcctacccaggcaggtacccttggaatcttctctccagacacagatggaaaacagccaaggtgggcactgaggacccctggcccaatctggcactgcaccaagctcccgtccctgtgccggctgaactatcctacctgatgctcttcgcagacttgtctccaggcttggcaggctgacccgccccccacctctctctggatcctctcagtcctctgcctacagacccaccactaccacttcagccaaacaagtcgtggaagcaccagcagtgaaggcccaggatgctggccagagagaacgccctgctgcccaaggctggggcccccgagggcctgtgctgctgggaaccccatcctgagagctggggagcagaggagactctgggcccagccctgtggaaaagccacggaagggggtgggacaggaagcagggtgagggttgagtgggcaggtggccccctcctgatagcttctaattaacttggatccgaggggatgggaaggggctgctgtgtccaggagggccagagagctgaggtcagaggtcaggacagtcactgcccattgccaagggggaggccagtgtccggggacaaagttctctggaagtcctcactttgcaacttttgaaaggagacagggccggcatgagtcatcccagcacctgatgaccccggtggcctggggtgcaggtgcctgctgaggccccacttccaatttttctgaagcctgggagaagaattcagaatagtggggcctgaggccagggccagcctgggaggcagagacgcgactggcgccccggatgagaaggggcttcggccctcccgagcccagcggggacacagagccctcgcggggagagggggctccgccgcgctgcgcgcaggagacgccagcagcgggtccgccgcgtaggccgttcggcccgggaccccggcccaggcctggcgcgcgggtgagcgcggccagggacgcgcacctggggccagcctcgccacccacctgtcacctggggccgggagcgggcgcggggcgcgggcctcggcctggccgggcagggccgatcgcgggcgcggggtgggggggcgaaggcagtgaaccaaaatggcgactttttctggagaaggaggaggcaggaagacggcgccggcgcggggcgcgggggctcgggcgcggcggggggcgggggggctccgggcccggccccctccttggcctgcgcgcagggtcgagatccggggcgcggtgggcgccggggctgcggccagaatgggtccggggcgcggccgggcgcttacctgcggcgcccagcggggctgcggccgggccgggccgggccggggcggggggcgcggggcgcggggcgctgggtccgggcggcgcaggctgcgcgccgcgctgcgcacatgcgcgctcccgcccctcccacctttgacagttttactgcgggggggagggggcgaactctcgcgttattcccgcggccgctccgcgacggggagggggcggggagggggcgggggcgggggcgggggcccggcgctggcctgtggttcccccgctccgcggttccgcccccgtcggccgggcccgcagtccagagtagccggttctgccgtcctggggcgggggacgttttttggacagtggggtaaactgaggcccgataggggcgctaggcactgcccggagtccggcgcgcacggattgaggcgacctgattccgccgcatcctggcccgcgcggcgagtgtggtctctgggctcgggaccctgacctctggccctgggggccgtgcaccggcagcgcaggattcagccttcttccaactggccctgagaccacttttgcgactgacccccggaggtgcctggcggcttaaggccatggggttttactggggtcactgaccattgggtcaccctttcccagctctgggggcagtggttctgaaccagtgccagggccttctctgccccacagcttgggcttctgcaggcagggggcactggggtccggtgtgggctgagtggtctggaggtggcggggcactgacagcacaggacttgggaatgaatgagacagagaaaggttggctctcctaaagaggactggtaggaggcaccacacgggactggcacaggacccacaagaatctcccccaggagagcctgcctgcctgcctgcctgccttccttccttccctctcttacttccttctctccttccttccttccttcttccttccctcccttctcttccttcccttccctccctccctcccttcttccttcctttccttccttcttccttccttccttttctctttccttccttctcttctcttccctccctcccttcctcccttccttctcttccttcccttaccttcctccctcccttcttccttcctttccttccttcttccttccttcccttcccttcctcccttccttttctccttccttcccttccttctcttccctccctccctttctccttccttccttcctttctctctctttctttttctcccctcccctcccttctcctcccctcccttcccctcctctcctttctccttctccgttctttttttattcttgagatagggtctcgctctgtcattcaggctggaatgcagtggtgtgatcttggctcactgcagcctctaccacctgggctcaagcaatcctcccacctcggcctcccaagtagctggaactacaggtgtgtgccaccccacctggctaagttttaaagtattcatagagacgaggtctttctgtgttgactaggctggtcttgaactcctgggcttaagccatcttcctgcctcagcctcccacagtgtgggcattacaggtgtgacccaccgcctctggctaggagggcatttttttttttttttttttttgagacagagtctggctctgtagcccaggctggagtgcagtggtgcgatctcggctcactgcaagctccgcctcctgggttcatgccattctcctgcctcagccaaccaagtagctggaactacaggcgcccaccaccacgcccggctaatttttttgtatttttagtagagacggagtttcaccctgttagccaggatggtctcaatctcctgacctcgtgatccgcccacctcggcctcccaaagtgctgggattacaggcgtgagccactgcccctggccttaggagggccattcttacctgttcacagcacccatctcccagggaaggcctcaggcctcaggagggaagagtcaaggagactctgggttttcatcttgtgcccatagagcatttttttttttttttttttgagatggagtctctctctgttgcccaggctggactgcagtggcgccatctctgctcactgcaacctccgcctcctgggttcaagcaattctgcctcagccccctgagtagctgggattacaggcacgtgccaccatacccagctgattttttgtatttttagtagagacggggttttaccaagctggccaggctggtctcgaactcctgacctcgtgatccacccacctcggcctcccaaagtgctggaattacaggcatgcgccaccgcacccagccagcattttttttaaaaccatgtgcatatattacttttataattaaaacagacttttaaaagtttcgtaatgcccctttttgcatactacaaatattctggactccttaaaattgatgtgggctggaagttgctagtcaggaaatggaactaccaggtgtgcctccttcgctggggcccttccggcccagtcggcccctttccctgtaccccgtggagcaagctcagaggcactgctagggggttgggcagtaagatttttgcctttcctcaaaggggcctgggatctgcttcactcaaggctggtgcagagcactcacatggagattggaggttggctcttatagaagaggcagtcagtcaatccttccttcgggaatctgagtcagagaggccagtgcacaccagcctgtgtgacccgaggaggaaggggagggcattccctgtgaggctagcgtcatcacgtccttcccttgttgacctttcccaccctggggacgggaccagcaggatttcctgaggggtcagtgtgtgtccccttaggtgcagccaaggccgtcagctctccctgtgtaagtctgggtgtccatacatgcgacctgtttggacattgccgtgtcaggatatgacagtgtcccatgctaggtgagaccaatgcctgtctgtattttagcatctgggcgactagacctcagggtacctggggacgatgtgtctggatttcagtatccatgtgtccaggctgcggcatgtctcagtgtcagggtgctggtgagggacggctgttttctgtgagcatctacatgccagggtgtcgtggaatacagtgtgtttgtgtgcaccggggatgtgccgtgtcccatgtgtttctatgtgttaggaggtcgttgtgtgtctgcatgctagtatttgtgtatttgtgtaatgacatctttgtatgggggcatgctgttacatacctttgtgtctgtgtgcctggccaactacatgcatgtgtttgtgtgtgttggtgtttgctggtgtcagtgtcattgagtctctgtgtgtggtttatgctcttatgtgtctgattgctgtgtgtgtgtggtgtgtgtgtgtgtgtgtgtgtgtgctgtgatctgtgtttgagacagggtcttgctctgttgcccaggctggagtgcagttgtgtggttagagctcactgtgccttgaactcctgggctcaaggaatcttcctgcctcagcctcccaagtagctgggactacgggtatgcgccaccatgcctggctagtttcaaaagttttttgtagagatggggtcttgctatgtcacacaggctggtcttgaactcctggccttcagcgacactcctgccttggtctcccacagtgctgggattgcaggcgtgagccaccgtaccaggccagatgtttgtgttttatccctgaacgtgtgaatgggatcttattgggaaaagggtatttgcagatgtgatgaaagatcttgtgatgaggagattatcctgtattacccaggtggccccaaatccaagcatccttataagagagagacagagggagatttgagagacagaagaggaggaggtgatctgattacagaggcggagacgggtaatgcccatgcgcccgagttcccccggcagccactggaagctggagaggtgaggagtcgccccaggaggccctgagggagctggattttggactgcggcctccagaactccagagagaatgaatgtctgctgttctcagcacccctccgtggtcctctgtcacggcagccgcgggaccctcacgcgctgtctgggccgtcccttccagcgtgtcgggcgttgtgtccagcactggggaccgcccacaggcgtgacttgagccctgtttccagcctctgcgcggggttgcccagacgcccctccagggcgtgacgccactgccccctggtggccgcggctgcccagacgccctctcctcgcagacccagcaccgccagcacttgggaaccagctttatttctgattttttttttttgtcagagtataaaaaagtgagtgcagcaaaacaaggaagacgagacaggcgtgcgtgggccagggcaagacagaggagaagggagggaagcagaggcagaagggccccttgggcgaaggctgatggtgggaggcgggcagaatacttgcgcagccacacaggggcagggatgagggtctccccgtggtgggggcttacaggatgggagcggccaggccagttgtccaaattccacctgggacctgcagtgaccagcctcgagtctggaggctcaaagcacacagaggggactaggggctcagcctcatctgtccctgagattttcagaagccacagggggactgggagagggcagaggcgcaagagggtggaggcggctagggccgccctcactgtccttccgccaggcagcaccagccccaaaccacccagagaggggttgctcaggcctctgggagggtgtaaggggagtggccctgggaaggcctctcccctgaatccaggccttcttgggaaagcagcaatgggaaggcccacgcacaaggcccttgttcttgagggcgaggggggaagaccataaaagcaagattttcccaaagatagggcagggagcactgctaagcctgggccctgggcgcggagccacctggacagggctggggttctcgttgtgccacattttgtctctggcgcttggtcaatctggtcctttctcagctttacttctcatgaatagagggggtgtggtgacgatgtataaataatgatgaaagtgcttggcatggtgcccgttaggcgggtgctgatggccactactctagatgatgggttggcctgctgggccctggcaggtgcatgggcacaagccacagggagccgaggcagcttatggtacctgtgtgggccaacctggaggtgctggggaacgacctagaactgggctgggtgggtggacagacaagtgactcagcaggcgatgggggaccgacatcacgtggagaggggaatgtaaataaacagactccctgggagtctaggggggacatccaaaccggttctggctccaggcagctgccccacatgctgccagctgcaccaggggagggcttgggctcaggtcccaggaggtggggccacactcaagcagccccctacccacccagccccagggcacgacctggaatgtccaaccagaggcgcctggaggtgtgatcctggtcctgtctgtccgttgggccagcctggccgccccggcatcccgcagggtccaagaggcgctgcggggccagcttggcctcctccctagccgtggactcccatcacagtgctggggtctgggttcaagcctcagcagcagctaggacattttcccgaaggaagctgtgtgatggaagagggtgagaatggggtggggtctttggcatcatctgcattagggcgcttactggggcctgcagccgacctcctgaggtcatcccaccccacactcagaggggcttctccatcagcccccaggcctctctggcacctcacactgaccttggctgagcagctgcaggctccgcccctcctcacgcacctgcaggcggagcacctgctgcagcacctcctgcctctgggcctcctgggccagccccatccgctgcagcttctccgcattcagccgcagcagtgcccggcctggggagaggaaagaggggctgagctgaggccaacagaggcatcaagagccaaggcaaggctggtgccatggctcatgcctgtgatcccagcactttgggaggccgaggcgggcagatcacttgaggtcaggagttcaagaccagcctggacaacatggtgaaaccccgtttctactaaaagtataaaaattagctgggcttggtggtgtgcgcctgtagtcccagctactcgggaggctgaggcgggaggatcacttgaacctgggaggtggaggttgcagtgagctgagatcgtgccactgcactccagactggatgacagagcgagactccttctcagaaacaaacaaacaaacaaacaacaaactgagccaaggcagaagcagggactgaaagagaaaaagggaggagagagagaggaagcgggaagcacgggcacagagagactcggagagagggaggagagagagaggaagcgaggttcagagagactcagagggagaaagagaatcagcaaaacacacagagacttaaaggagagaggcagagggaaaggaaggagagcaaaaggcagggacggaacagagaaaagccagatgaagacagcacagagagatgggaagagacacagaagaaaggcagagaggtccggacgcagtggctcacacctgtaatcccagcactttgggaggctgaggcaggcggatcacctgagatcaggagttcgagatcatcctgggcaacacagtgaaaccctgtctctactaaaaatacaaaattagccaggcgtggtggtgcatgcctgtaatcccaggtactcgggaggctgaggcaggaggattgcttgaacctggcaggcagaggatgtggtgagccaagatcgcaccatttcactcagcctgggcaacaggagtaaatctctgtctcaccaaaaaaaaaaaaaaaaaaaaaaaaaaagaaaggcagagagatagaaaagacagattctgcggagatgaagaacagaggggaggttgattcacaggagaaactagacagacgaaaacaacagcaagagaaaggcaggctgagtgtggggaagagacgctctgaggcaggttagccccactcccacagcaccctcagcgccactgtaccggtgatggcatgctgggagaaggcctccacgtagacgaggtagttgtggggacagtgcttcttgagccacttgcagacgtcctgctgactccacaggaccacgggccgggtcaggccacccagcgaggggcttgtatggtacaggccatagtggtcagagtacagccggccctgcaggggaggggcgtggcaggcagagtgagagtggtggagaaggagggcagggacggaggtgggtggagtgggtgggtacctggggggtgtctgtgccgggctgctgcaggagcttgattggcctgctgctggccgccctctggctgcgggagtcatgccacgtgaggctggtgccaggtgtccgaggcaagtggcaggggatgctctcagctgacaccgtgtgctccaggagggtccggcagaagctgaagtgggcagtggctgtgtgtgggggtgcctggtcagggcagtcaagggcagaaccagaggcttcctctacttgagagctagctccctgccccatctcctccacactagtgcgggaaatcacctccccaatgaggggttcccaagcctccaaaggcagaaggaagtgtgcaggacctgtttcgaggacctcacccagcacaaaaagagaagaactggaaacacctttcatcttgcaagtctacagccctcacccaggggagcaggatggattcttagatcagaggatgtgccctctagggaagggaacctgagacatatgacaagaggagctatcctgggacagccctgacctcacccttgccttgggctggcccacaagtcttgcacacaccacaccagaccaggaagtgcacacacggcctgctttgaggaaaggcagatcccgagtccggggaggtcgtctgtgctggggaaaccgggctgaggatgctgcttgcccatcgccactgaaggcacccagttcacacagccctatctggtgttggggcccgactcactgactatgactcattgacagcctgaactgtgggccaactgacaagcagggctcactccgcaaacacgcgctgggctctccagctgtgccgccccccacagggcctgcagcccgggacaacaccggccatgtgaatggtgggtacccattggatatgggcgggtcagcacaggtatgtggggtgcagccattgcttggggacccacggtgatgctctgtgctccctcttcccacagtaactgcattaaagtgtttcatctgagctttgtcatcatctctgggggcactgctgacctgagtctggggaggcaggcgtcttgatccaggtctggttacagaggggcaccccacattcattgtcaatgaatgaatgaatgaaggctctgtatggtatctgcaagtgaacagagcctgtggggagacagaaggtgggcacaggcctgcccctgtctttacagcaccctagcacccaggccttcagcagggcaggtgaggttcccacgctagggccctcatcccatccaccctagagtgagagaccctcccggcctcagactcagccacccactccacacccagggcaggggttggggatgtgtctaggaggtctaagtatcggtgaaaaccacatcctacttccccgtcctcccacgcctgtaagacttaggagacataacaccttccgcccccattcttgcaactttcaggaaccggacccctgggtgactccaaatttgaggtctggggtcagcagagggtgtgctcagtgggccaccgccccgaggtggcccctagtgctgtgggaaaaggcttattctaagcccgcgccttccagcggacaggcgccgtggtcgccgggctttgcagggcctcgagcggcggggctggtgcagaagcgcgcggcagtccggggaaacccgtcggactcctcagcccgcacggcacctgccccggccaagcaggctccgcccatttcctgcctgcactcccggagggagttccgtccgtcccgcggtctgtcggtccggtccctcccgccccaacgtcaggattccagaaggaaatggggcgggggcaccgaggcgggatgtgacctcggccccctttcggccccactgcaaaagcgggggagggttttccccgtgcgcaggaaaaggtgacccgagcgtagtgccagcctggacacaggcgccccggcttgacaccccctcaccccaagccaagggcgcgctgacccccaaggcctgaggctggctgccccctaaagcaggacaaaggctacgggaccccgttgagccgagacatccgccgaatacccccagccaccgccgctcgaagcccgccgggtcccgccccgcccccgtgcctctgggtccctgagacccccgcccgagaaatccccgctccccaatccagccccgctcaccgtccacatcccggcgctccccgaagcccgcgcgcacggccccggcgcggccacgcggggggctcagcttggacctcagctcggtgaacatggggcccgcgggtgccaggcccgcgcacacgcccctcgccgagtgcagggcggccggtgtggccggcggggaacgcgcgccgccgccccgccccgccccagccggccccgcgcccgagccggtccccgcggcccgcgagtgtgcgcgacgaggcacctgccgccgagccctgtgtgccgggcgcgctccgggagctccgaggtgtgtcggcggcgcgcgggcctgcgtgcaccaaggctgtccgccagggcgaggggcgtccgtgcgcccctgggcacggctccgcggaggagagtccccgtgaacctgccgggcgtcctctgaggtcgggcccctctgtgcgtgggggtgggctgaggggcatctcacaggggtcttctacctaccggggccaggacaaggggcaggtcaacgcctcccacacactttcctcggtctcctacgtctttactcgccttcaaataggcacccgcttccccggagaaaccagcttgactcttgcttaccgcccaccccactgtgaacatcagggtggttctcccttccctctgcagccccagaacctggctcagtgcccgggggagagggggcggtacagtgctctgtaactgaaaggggcttggcttgcctggagatggggcagaggggaactccaaggaggctgtagcaggccggagcggtgtgtttgctccaggactccagtgagaagtgctgagatggggctgggctagggaactgtggttgcctggtgcagcagcaggccaggcttgcaaccagctattcggcttgctctgcccaggagcctgggtgctctccctgggtgtatgtaggggctctggaggatgtcttacagcaggaggaccagagatgcacacagacatgtagaaatgcatgcacagagtacagtcatgcacttgcacccaaaacacgagcacacgtgacctctgtgcacacaccccactaatcacacacacagaattcacccacatgcttgacagccatgttcatgtactgacgtgttcccgacagctcagctgcggttatttatttcgtcaattagctctccaggagctaaggatgtggccctcaccagaatgtccaaggcatgttggcgggcgtgggtggggtctctagtcccactggagggacagatgcctgaatgggggttcaagaatatgagtgctaaaagcgtagggcagcagtgtgcgcacaggacgcacacagacaggtgtgcccataaccagtacacacaagctctacacaactggacagggtacagctctgctcggacagggcgcaccaggggcgagggcgggcagctgggctggttcagagggagggggccatgggttcagagggaggggaccatgggtcccactctcacagacaggtctccggactgcatcagagcactcgggaagcagcaatgccccaggctgtttttagcccccaggggccagttagggtcccagtgcaagctcgacctagcttcttccgcctctccacgaggaggcgctcccgcgcacgcgcctaccacgttcctgccccctagccgcggccggaagtcgtcgaaccaggacgtcgggacttccgcccagggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccgggggtgaggcctggggcggcgcgcgaggggcggggacccggctacaggagcgcagtgctttggggcgtgtttgggggcgggggtctatggccgcgcagtctgaaagacgcttggtggatcggcttaatccctgcaggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagaggaatctgacgtgtagtggaaacacgcgaccaccttcctcaggtcgggctgacactccccccccccgcccgcccgcccgccccgccttaagcgtgcctgggtcctctatgcctgcaacacagatgaccaccgtgcgttgctggataagtgagcagtcgttattatcctatttggctattcatttgatgaggaacactactgggtttttcttggtggtggtattatattggaatctgtggggcacacacaagctcactaaggagggtttgctattaccataaataagtacgtaaagaggaccagatttagaacccagtgcttaatggagagtagcattggagccaagtttagtaagagagctggacttagggctgtagaaacggtgacgatagaagagaaactgacattctgcgtgtgggagttcaaaaaaagtgaggcaaggaggaagcccagggaacaggagggagtccagtgtgagtggaatgtacagcgaatagaatagagctcaggaggttggaggggccttgagcgtcaggctagagctcctggagacgttagaaagatcatgacccttcagaattattattattattattattttttgagacaaagtcttgttctgtcgcccaagctggagtgcaatggtgcgatctcagctccctgcaatctctgccccccgggttcaagcagttctctgcctcagcctcctgagtagctgggattataggtgcccgctaccacgcccggctaatttttgtatttttagtagagacagggtttcaccatgttggccaggggggtcttgaactcctgacctcatgatccacccgcctccgtctcccaaagtgctgggattacaggcgtgagccaccacgcccggcccagaattttttactcagagctgtgttttgggaagaatcatctggcagagcatgggttgaagtagaggaaggctaaaggcagggagaggtaacttggtttccagctgtgatgggagtcatagtctgggaaggagggattttgaaagtggattcattagtacttggggacagacaggatggggaaagtgggagagggaggcaaaaattacatcatggtcccgtggcatctgggacagctgttatcagctgaaaccccccagagcagctgtaaggtgggcacggaagagctcagtgtgggccaagttgggtttaagggcctggttggatgtggagggggagatgatcgaagccttagggtggagagagattgccttggtaacatcatcagggtaggctgaaactttcaggtaagcagagaagatcagaagtgtttgagactgcagttcattgtcaccaggatctttggaggtttcccaaaggtgttagaaaaagaggtgttagtaagtgataaccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgaggtgagatgtgtccggctttcgtggctcctccagccagtctctgggagcagctgacctaaccagtgtgtgttggtgtctgtaatgaatggcttggagtggctcatgcatttaaattttagctattcatggaacatctttactgagagtgagagggagcaggaaaaacacggagaaatgtgcactttttgtccctcagaagagatgttcttgcaggtgttaggaccactgccttggcattttctattgcccagtcttttttttttttgagacggaatttcgctcttgtcggaagagatgttcttgcaggtgttaggaccactgccttggcatttcctattggccagtcttttttttttgagatggaatttcgctcttgtcggaagagatgttcttgcaggtgttaggaccactgccttggcatttcctattggccagtctttttttttttttttttttgagacggactttcgctcttgttggccaggctggagtgcagtggtgtgatctcagctcactgtgacctctgcctccccatttcaagcgattctcctgcctcagtctccaagtaactgggattacaggcatgcgccaccatgcctggctaattttgtatttttagtagagacagggtttctccatgttggtcaggctggtctcgaactcctgacttcaggttgtccgcacgcttcggcttcccaaagtgttgggattacaggcgtgagccactgcgcctggctgccagtctttaatgataaaaacttaaagtggaattggtgatagtatttgctttttttagctttagtgattgccctctaaacagacatctaaagaaaaacttcagctgactgaataccgattaactgtcttctaacagatgacatttttcctctgaggaaaatttttaaaaataattttagttttgaggccaggtgcggtagctcacacctataatcctggcacttttggaggccgaggtgggcggatcatgaggccaggatatcgagaccatcctgtttaacatggtgaaaccccgtctctactaaaactacacaaaaattagccgggcatggtggcatgtgcctgtagtcccagctactcgggaggctgaggcagaagaatgctgtgaacccgggaggcggaggttgcggtgagccaagattgcgccactgcactccagccttggcgagagtgcgagactctgtctcagaaaaaaaaaaaaaattagttttgaaataattttaaatttgcaggaatttgcaaaaatagtgcccccccaaaaaaaagtttctgcatgtctttcaccaagcttctcccgatgttacatgaccttagtgcagttattgaaacgaaggagttaacattgacacagtactattaactaatttgtcagtcgtatttgcatttcatgtttttccatgaatgtccgctttctggcttaggcttagtccaggatcccccattgcatttcgtcatgtctccttggtcccttccaattgggggtctcctctgtcttccatgcccttgacgcttgaagagtagtcaccagttatatggtagactgtcccttgatttggcttcgttggctgaagaaaataatttagcaagtatttcacaagtagagatctccgtttcgctggtggggatggtgttgaaggaaaagctgacctctacacgtgttgtttgcttctcagtttaatggctatgctgggagcctcttctcaagtggaccctacgagaaagatgatgaggaagcagatgctatctatgcagccctggataaaaggatggatgaaagaagaaaagaaagacggtaaaagaaattgttgcctttcacaatatttatccaagtttaaaaaaaagttttgtggccaggcgcagtggctcacgtgtgtaatcctagcactttgagaggctgaggtaggacgatagctagagcccaggggtttgagaccagtgtgggcaacgtagggagacttaatctctacaaataatttaaaaattagccagatggtacacacctgtagtcccagctacttgggtggctgaggtggaaggaccgtttaagcccaggaggtagaaactgcagtgagccatgatcattccagcctggttggcatagtgagaccctgtctcaaaaaaaaaaaaaagttttgttttgaattgttttatatttggagaaaagttgcaatagagtatgtgtgtctgcttagcttttaggccacctgagggtcttggtctgtcgtagccatgcctggataagcactgggctgttacagaacagccttagggcctgggggctgcagtggagagcttaagaactcttaagtttttccagaaatcagcagaattttgtggattacttttacgatacatcagggttaccatctttgaaatgaaaagggcctactgacttgattattatatgttgagtaatttgcaaatgaattaaagatgttaaatgacacatacaagctaccaagattgaaccatgaagaaatcccaaacctgaacagaccaataaaaggtaatgagatcaaagctgtaacagaaagtgtcctagcagagaacatctcaggatctgattgcttcattgctgaattttaccaaatatttgaagaagaactaataccaattctactcagactattctgaaaaatagaggagggaatacttccaaacttattctacagaaccagtattaccctgataccaaaaccagacaaagacacactgaaaaaagaaaatgttaggtcagtatccctgatgaacactgatgcagaaatcagcagaatactagcaaaccatattcaacaacacattagaaagatggttcatcggctgggcgcagtggatcacgcctgtaattctagcactttgggaggccgaggtgggcggatgatgggtcatctgaggtcaggagttcaagaccagtctggccaacctagtgaaacccagtctctactaaaaatacaaaaattagccgggcatggtgggtggtgtacgcctataatcccagctacttgggaggctgaggcaagagaatcgcttgaactcgggaggtggaggttgcagtgagccgaggtcacaacactgcactctagcctgggagacaagagcaagactccatctcaaaaaaaaaaaaaaaaaaagatcgttcatcatgaccaagtggcattttgcccaggggatacaagtgcaagggtggttcaacatatgcaaattaatcagtgttatacatcatatcaacagaatgaaggacaaaaaccatatgatctttttttttttttttttgagacggagtctcgctctgttgcccaggctggagtgcagtggcgcaatctcagctcactgcaacctccacctcctgggttcaagtgattctcctgcctcagcctcctgagtagctgggactacagttgcccgccaccacgcctggctaattttttgtatttttagtagagacgggatttcactgtgttagccaggatggtcttgatctcctgacctcatgatccacctgcctcggcctcccaaagtgctgggattacaggcgtgagccactgcgcccggcctaatcattttaattgattctgaaaatgcatttgataagattcaacattccttgatgataaaaactctcaaaaaactgcatatagaagaaacatacctcaggctgggtgtggtggctcacgtctgtaatcccagcactttgggaggctgaggcgggaggactgcttgatctcaggagtttgagaccagcctaggcaagagggtaataccttttctttacaaaaaaatacaaaaattagccaggcttcgtggcacacacctgtagtcctagctactcaggaggctgagatgggagaattacttgagcccaggaggcagaggttgcagtgagctgagatcataccaccacacttcagcctgggccacagagcgagaccctgtctcaaaaaaaaaaaaaaaaaaaagggggggggagcataacacaataaaagctatatacagctggatggggtggttcacgcctgtaatcacagccctttgggaggcccaggcaggcagatcatttgaggtcaggagtttgagaccatcctgaccaacatggtaaaaccctgtctctactaaaaatccaaagattagttgggtgtggtggctcaggcctataatttcagctactcaggaggtggaggttacagtgagctgagattgtgccactgcactccagcctgggcaacacaatgagactgtgtcgcaaagaaaaaaaaaagccacatatggtaggcccacagctcgtatcatactgaatggggaaaaactggaacgcaacaaggatgcccactttcaccactgtgattcaacattgtactggaagtcctagctagagcagtcggaccagagaaataaataaaagggcatccagattggaaaagaagaagttaaattatccttgtttgcagatgatatgatcttatatttagaaaaccctaaagactctaccaaaacactattggaactgacaaattgattaaagttgcaggctatgcccccaggtgtggtggctcacacctgtaatcccagcactttgggaggctgagggtgggtggatcacctgaggtcaggagtttgagaccagcctggccaacaaagagaaaccctgtcactattaagaatacaaaaatggccgggcacggtggctcacgcctgtaatcccagcactttgggaggccgaggcaggtggatgactggaggtcaggagttcgagaccagcctgaccaacgtggtgaaaccctgtctctactaaaaaaattacaaaagttgccaggcgctgggactcacgcctgtaatcccagcaccttgggagagtgaggtgggtggatcacttgaggtcaggagtttgagaccaggctgaccaacatagtgaaaccctgtctctactaaaaatacaaaaattagctgggtgtagtggcacacgtctgtaatcccagctactcaggaggctgaggcaagagaattgcttgaacctaggaggcaaatgttgtagtgagctgagattgcaccactgcactccagcctgagtgacggggcaagactctgtctcaaaaaaaaaaaaaaccaaaaaacaaaaattagccgggtgtgggggtgcacgcctgtagtcccagctagttgggaggctgaggcaggagaatcgcttgaacccaggaggtcgaggttgcagtgagctgagattgcaccactgcactccagcctgggtaacagagtgagactccatcttaaaataaaagaaaatatccatactacccaaagtaatttacagattcaatgcaatccgtatcaaaatactggggacattattaacagatagtgaaaaaatagccaggtgcagtggctcatgcctgtaatcccaacactttgggaggctgaggcaggtggatcacttgaggtcagcagttcgagaccagcctggctaaaccccatctctactaaaaatacaaaaattagttgggcatggtgacaggtgcctgtaatcccagctacttgggaggctgaggcaggagaatcacttgaacctggaaggcagaggttgcagtcagctgagatcgtgccattgcactccggcctgggcaacagagtgagactccgtctcaaaaaaaaaaaaagaaaaagaaaaaataattctaaaatgtacatggagccaaaaaagacccagaataggcaaagctatcctgagcaaaaggaacaaaactgggggaacacttgacttcaaattatactacagagctgtagtaacaaaaacagcatagtactggcagaaaaacagacacatagaccaatggaacagaatggacccagaaacaaataggtacctctacagtgaactcattcttgacaaatgtaccaggaatatttattggggaaaagacaatctcttcaataaacggtgctgggaaaactggatatctatatacagaagaatgaaactagacccctctctgtcaccacatacaaaaatcaaattaaaagactttaagacctcaagctgaaactactagaagaaaacattggagaaactctacaggacattggactaggcaaagatttcttgagtaataccccacaagcacaggcaacgaacggaagccaggtgtggtggctcgctcccgtgagccaagagtgcgctactgcactccagcctgggccacagagactgtctcaaaaaggaaaaaaataaaaagttctcattatagaatattaggaaaataagagtaagtatgggtaaaagcataacatttattcataagtctagaaagtaacagttaacattttggctcatttcctctttctgttgcttttttttatcttggctcactgcaacctctgcctcccgggttcaagcaattctcctgcctcagcctcccaagtagctgggattacaggtgcctgccaccacgcctggctagtttttgtattttagtagagacggggtttcaccatgttggccaggatggtctcaaactcctggccttgtgctccatccacctcggcctcccaaagtgctgggattacagacgtgagccactgcgcccagctctgttgctttttatacatgtaatcataacttcctgtgatgtatgtagaatgttttattttttgaagataattttagaatagtaaaatatagttcttctggaattttatttattttttatttttttgagtctcccaggctcaagtgattcttctgcctcagcctcccaagtagccgggattataggcacgcgccaccacacctggctaatttttgtgtttttagtagagacagggttttaccatgttggccaggccggtcttgaactcctgaccccaagtgatccacccgcctcagcctcccaaagtgttggaattacaggtatgagccaccgtgcccagtcttgccacacactttaaacaaccagatcttacgtgatgtaaacttgctgcctcgaggacagcaccaggccatcaggggtctgccctcaagactcaagtggcctcccaccaggccccacctcaaacattgggaattataattcagcatgagatttcatggggacacagatgtaaaccatatcctttggcctcccagagtgctgggattacagacataagtcaatgtgcctggcctggacatctttttagaagctcgttattaaatcattgtgcataaattttatacctatagtaattaaacgtgaatggcattgcatttcacttttttttttttttggatacaggatcttactctgtcacccagggtggagcgcggtggcttgattatagctccctgtaaccttcaattcctggctcaagcgattctcctgcttcagcctcccaggtagctgggattacaagcacgtgctaccacacccagctaatttttcttttttctttttttttttttgagatggagtctcactctattgcccaggctggagtgcaatggcgcaacctcggcttactgcaacctccgcctccagggttcaagtgattctcctgcctcagcctcccaagtggctgggattacaggcatgcaccgccacgcccggctgatttttgtagagatgggtatttttagtagagacggggtttcaccaatgttagccaggctggtcttgaactcctgcccttgtgatctgcctgccttggcctcccaaggtgctgggattacaggcttgagccaccacgccaggctcacacccagctaatttttgtctatgttgcccaggctggtcttgaactcctggcctcaagtgatccacctgcctcccctaaccttggcctcccaaagtgctaggattacaggcatgagttactacactcagccctacattttaaaaattgattggaacctccagggttaatgcattttaaaaaacatcaggctgggtgcagtggcttacatgtgtaatcctagtaccttgggaggccaaggcaggaggaccacttgagtctaggagttcgagaccagcctgggcaacatggtgaaaccctgtctctacaaaaacaaaattaaaattagccagttgcacatgcccgtagttccagctacattcccaaggctgaggcaggagcatcgcttgagcctaggaattagaggctacagtgagctatgcttatgccactgtgctccagcctgggcaacagaccaaggccgtgtctctaaaacaaaaacaaaacaaaaaacagcaggtgacacggacccatgaagaaagccattaaattaaatgtttttaaaaagtagtgtacttggccgagcacggtggctcacacctataatcccagcactttgggaggccgaggcgggcagatcatgaggtcaggagatcgagaccatcctggccaacatggtgaaaccccgtctctactaacaatacaaaaattagctgggtgtggtggtgcatgcctgtaatcccagctactcaggaggctgaggcacgagaatcacttaaacccaggaggcggaggttgcagtgagctgagatcgcaccactgcattccagcctggtgacagagtgagactgtctcaaagaaaaaaaaaaaagtagtgtacttattaaaactttttattctgaaaactgtcgtaatacaaacaagtaggaagaacagtactgtgaataccatatcctcacatgtagtctcaacaccgaagtgcaattacatgggttatgttctggcacatagagctgtgcagctgagctgagttggttagaggtgaactatttacttggaagagaaggaagcaaggaaggaaaggtgggatgagttcagtagagtgtttggagtgtttggtggtaactaggatagttactgtttttccttgtaggtgtttttttgttttgttttgttttgttttgttttgcgacaaggtctcgctctgtcgcccaggctagattggctcactgcaacctccacttcctggattcagatgattctcctgcctcagtctcccaggtagctggggattacaggtgcccaccaccatgcccagctaatttttatttttatttttatttttttgagacgaagtttcactcttgtcacccaggctggagtgcaatggcatgatcttggctccctgcaacttccacctcccaggttcaagcaattctcctacctcagcctcctgagtagctgggataacaggcatgcgccaccacgcctggctaattttcatatttttagtatagatggggttttaccacattggccaggcttgaactcctgacctcaggtgatctgcccacctcggcctcccaaagcgttgggattacaggtgtaagccaccacgcctggccttcttaggtgtttatgggatggtcctacctttgggattttgtgaattttcaagcagtaaatatacacatgtccaaatggaggtatttagatcaaagtaagatcttttttttttattttaatgaatttctacatgtttttatttggtggataattgaattagtagacttacgaatgtatttatatttatttatttagaggcagagtctctctgtgttgcccaggctggagtgcagtggtgcgatcttggctcactgcaccctctgcctcctgggttcaaatgattctgcctcagcctcccaagtagctgtgattacaggtgtgtgctaccatgcccagctaagaatgtattcatagttaccttaaaatatatttgatttgggctgggtgcggtggctcacacctgtaatcccagcactttgggaggccaaggtgggtagatcacaaggtcaggagttcgagaacagcctggccaggatggtgaaaccccgtctctactaaaaacacaaaaattagctgggagtggtggcgagcacctgtaatcccagctacttgggaggctgaggcaggaaaatcacttaaacccaggaggtggaggttgcagtgagctgagattgcgccactgcactttagcctgggtgacagagcaagactccatctcaaaaaaaaaaatgtgtgtgtgtgtgtgtgtgtgtgtgtgtgtgtgtgtatatgtatatatatatatatatatttgatttagctactaagagtatggaattgttctttttggtgatttaattgagatggataataaatttgcttcagaacagacatgcagtgtttctgatgtgtgcatgttttatttcctagggagcaaagggagaaagaagaaatagagaaatatcgtatggaacgccccaaaatccaacagcagttctcagacctcaaggtgagccgatgaagcggtgaatggtgtgcggtttctaacgctctcaccctaacccgcagagactcagactgctcttacgtggaatttatgagactttacgtttttaatttagggggtcattgcttagaagaagaaagtgtttgcttcagtatgtttaattatatgtgtgtaaaaaaaaacccttcccctactgtaaaaggtaggacaaatgaacttattttctttgtaattttgactccatttatacctaagattttcttttttcttttttctttttttttttggaggcagtctggctctgttgccctggctggagtgcagtggcgtggtctcagctcactgcaaccttcacctcctaggttcaagcaattcttgtgcctcagcctcctaagtagctgggattacaggtgcctgccaccatacccagctaatttttgtatttttagtaaagacaggatttcgccatgtgtaccaggctggtctcaaactcctgaactctagtgatctgcccacctcagcctcccaaagggctgggattacaggcgtgagccaccacgtctggccccatttatacgtaagattttctaaactgtgtcccctgggctttgagagaataatttacattttagtgaagttgaacagatccaataaattgatttttcttttctttttcttttttttttttttttgagacggagtttggctcttgttgcccaggctggagtgcaatgacgcgatctcagctcaccgcaacctccgcctcccaggttcaaacgattctcctgcctcagcctccctagtagctgggattacaggcatgtgccaccatgcccggctaattttgtatttttagtagagatggggtttctccatgttggtcaggctggtctcgaactcccgacctcaggtgatctgcccgctttggcctcccaaagtgctgggattaacaggcatgagccaccgtgcccggcctaaattgatttttctaagtgaagtagaaaactatttttggggctgggtacagtggctcacatctgtaatctcagcactttgggaggctgaggtgggaggatcacttgagcccaggagtttgagaccagccttggggagaacctgtctttacaaaaaataaaaacttagccaggcatggtggcccacgcttgtggtcccagcaacttgagaagctgaagtgggaggatcacttgagcctgggaggttgaggctgcagtgagctgtgattgtgccactgaatccagcctgggcaacagaatgagacccatctcaaaacaaaagtaaaaaacagttgctgcatccaaatcccttctaaagcttggtgatctggaggctaggggtgagagagggcatggtcctacctgggcacatgaaattctgtcagagaattaatgtttttgggggctggatatttccagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactgtgagcttccaaaaaagggcacatgtggcccatttagtcctgttagatcagtggcaggaatggtgggtggtgttggattcaatgcttctgcaggtcatggctatgctgtggccgagtctgtctgcacagctgtgcatatgtcaggccactggggaagtatttcagagagtaaatttcttgggcatgcagtgcaaaccgttgttttattcttgcctttcctctcttcccctccagcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgagtttgtcacacagcattttcctgtggacaggtttagacagtttaattttgttttgttttctttttctccttcttcttcttctcctttttcttctcctccttctcctcctcctccttcttctccttctcctttttttttttttggcttgatttttgcctgaataattccgcagatttttaaaattttgacccagagtcttgctgtgtcactcagaggctggagtgcaatggtgtgatcttggctcactgcaacctccacctcctgggttcaagtgattctcctacctcagcctcctgagtagctgggattacaggtgcccaccaccacacccggctaatttttgtattttttgtagagacggggttttaccatgttggccaggctggtcttgaactcctgacctcaggtgatctgtctgccttggcctcccaaaatgcggggattacaggtgtgagccactgcacttggcctttttttaaaatataaaataataattttttaaaaagtgtgtttttttcctgcctctcagtaaattgtcttgtggccctgcatggaacgtgtactttgatctggagactaggtgctctagacaccagtgaagtacagaactctttctgatatgcatatcagataccacgaaggaacatactacttttggcctggccaacatggtgaaaccccgtctctactaaaaatacagaaattggccaggtgtggtggcgggcgcctgtaatcccagctacttgggaggctaaggcaggagaattgcttgaacccgggcgttggaggttgcagtgagccgagattgcaccagtgcactccggcctgggcaacagagtgagactgtctcaaaataaaaaacaaaaacaaaaacaaaaagtggcacaatcatggctggctacatacagccttgacctccctgggctaaggcgatccttccacctcagcctgccaagtagctgagattacaggcatgtgccaccatacccaactaatttttgtattttttgttgagatggggtgtcactaggttgcccaacctgggctggagctcctgggcacaagtgatctgtccgcgctggcctcacaaagtgctgggattacaggtgtgaactaccatgcccagcctgaaatttgtttacatagaaattgtaaaactttttgggccaggcactcatgcctgtaatcctagcactttgagagaccaaggtaggaggattgcttgaggtcaggagttcaagaccagcctgggcaacatggtgatggtgagactctgtctctacaaaaactaaaagaaatagctgggcctggtggtgcctgtagtcccagctgttcgagaggctgaggtggaaggattgcttgagctagggagtttgaggctgccatgagctatgatcgcgcctctgcacaccagcctgggttacggagtgagactgtctcaataaataaataaaactgtcacagtaatttttttgtggtaaaatatatgtaacacagaatttaccattttaatcattcttgactgtacataccttcactgacataattatgttcatgttgttatacaacctcatcaccattcatctccagaactgttttcatcttcccaaattgaaactccgtacctgttaaacattgagtccccgtgcgctttctccccagcccctggcatccaccgttctctctgtttctataaatgtcactactctctggatcttatatgactggaatcatacagtatttaccttactgtgacaggcttatttcaattagctcatggtgcagcatgcgtcagcatgttcttttttttttttttttttttgagacagagtctctctctgtcacccaggctggagttcaatggcatggtcttggctcactgcagcctccgcctctcgggttcaaatgattctcccacctgagcctcccaagtagctgggactacaggtgtgcaccaccaagcccagctaatttttttttttttttttgagacggagcctggcaccgtcacccgagctggagtgcagtggtgtgatctcggctcactgcaacctccacctcctgggttcaggtgattctcctgcctcagcctcccgagtagctggaactataggcgtgtgccaccatgtctggctaatttttgtatttttagtagagacggggtttcatcatgttggccaggatggtcttgatctcctgacctcgtgatccactcgcctcagcctcccaggatgctgggattagaagtgtgatttttttgtatttttagttagagatgggatttcaccatgttggccaggctggtctcgaactcctgacctccagtgatccacgtggctcggcctcccaaagtgctgggattacaggcatgagccccggcgccccggccagcatgttctcagtttaaggcaggatgagacttgactctttggtgtgtgtggaccgcattcgctcatctatgtagaccgcattcgctgacctgtttattcgctgacggacacttggaccactttcaccttttgactattgtgaataatgctgctgtgaatacgggtgtacagatatttgtcagagaccctgctttctattctttcttttttaataaaaattttatttatttttttttgagacggggtcttgctctgtcacccaggctggagggcagtggcgtgatctcggctcactgcagcctctgcttcccaggttcatgtgattctcctgcctcagcctcctgagtagctgggactacaggcatgtgccaccacgcctggctaatttttgtatttttagtagacacggggtttcaccatcctggccaggctggtctcgaactcctgatcttgtgatccacccaccttggcctcccaaagtgctgggtttacaggcgtgagccaccacgcctggtcaaaaattacacttttttttgtagagacagaatcttgggaggctgaggcaggaggattccttgagcccaggagctggaggctgcactgagctatgattgccactgcactcctgcttgggtgacagagtgagaccctgtctcaaaaaaataaataaaaatatagatc

SEQ ID NO: 29 - DNA, 6135 bp, Homo sapiens
actgtctctccccatccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaaaaaaaaaaaaaaaaaaaaa

SEQ ID NO: 30 - DNA, 6878 bp, Homo sapiens
actcactatagggctcgagcggccgcccgggcaggtcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattagcttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtg

SEQ ID NO: 31 - DNA, 105230 bp, Homo sapiens
gcatgcaccaccatgcctggctaatttttgtattttttggtagagacagggtttcctcatgttgtccaggctggtcttgaactcctgacctcaagtgatccacccaacttggcctcccaaagtgctgggattacaggcatgagccaccatccctggccctatttatttatttttgagacagttctgtctcactgttgcccaagctggagtgcagtggtaggatcatggctcactgcagcatcgacctcctgggttcagcctgtcctcctgcctcagtctcctgagtagccgagactatgggtgcatgccaccacacccatctactttttgtattttttcgtagagatgggggtctcactatgttgctcaggctggtcttaaactcctgggctcaagttatccacccaccttggcctcccaaagtgctggaattacaggcacgagccactacacctgacctattttaaaatgtaggatatttttgctgaatgcataattttaatgttcctattgtgattttattaattatcactaatccttcattgtttgattaataaaggagggcaattagatgttagaattttgcagattgtaccagtgacacatggtcccttggctagaattatgcataactttgattgttttgagcaaacaactgtgaggtcagtgacaacaataatgacaaataatattcaagtaacctcttgctgttaatactgggttttgtggccaggcacagtgcctcacgccttgtaatcccaacacttcaggaagccgaagtgggcagatcacctgaggtcaggagttcgagaccagcctggccaacagagtgaaaccccatctctactaaaaatacaaaataattagccaggcatggtggcacacatctctaatcctagctactcgggaggctgaggtaggagaatcacttgaacccggaggtggaggttgcagtgacccgagatcgttccactgcatttcagcctgggtgagagagtgagactctgtctcaaaaacaaaacaaacaacaataaaacaaaacaaaactaaacaaaactgggttttgtctttaactgcctcatggaaacatataggagagttgtgaaataagtattcttattcccatttaacaatgaggaaacagtcttggagaggctagctcccatgtttgatgtgacagtacactaacataagtaagagaagtaaagaatgcagcacattccaggccgggtacagtggctcatgcctgtaatcccagcactttgggaggccaaggtgggtggatcacttgcagtcaggagtttgagaccagcctgtcgtaaatgacgaaacccggtctgtactaaaaatacaaaaattagctgggcgtgatggcaggcgcctgtaatcccagctacttgggaggctgaggcagaagaatcgcttgaacccaggaggcggaggttgcagtgagctgagatcatgccactgcactccagcctgggcgacagagagagactctatgtcaaaaaaaaaaaaaaaaaggcagcacattgggtatttcaacattttagaaaaaggaataaacaaaaccaactgttatacaaatagaaagggaaggactacaggatccataaaatacttacaggaattcttcgaggcaggacagaatcttttctgctgagagaccggggtgaaggcattgtgcaaggaggtggtatttgaaggatgagcaagacttggtttgcatgtgggaacaacatgccaaatagagggaaccacatggcctagactggctgaactggcagcctttattgtgcatacagagggctccttttggctgtgcaaaaattaggataaggttgtgaagtctagaaaatataatttttcatgtctctaaatatttgggttcaaaagtaaaatagtccaatttgcaaaaccttcacgagaaagggacgattgcttaagtcttggtgtttatgtgtcttttttgttattctattttttatatattatttatttatttatgtactttttgagacagagtttgtcactgtgttgcccaggctggagtgcagtgggcaatcttggctcactgcaacctccgcctaccgggttcaagcgattcacctgcctcagcctcctgagaagctgggattacaggcatccgccaccacccccagctaattttttttgtttttttttgtttttttgttttttttaagcgggggacagtctcgttctttcgcccagtttcaagtacagtggcgtgatattggttcactgcaacctttgcctcccaggttcaagcgattctcctgcttcagcctcccgagtagatgggactacaggcatgcaccaccacgcctggctgattttttttttttttttttttttgtatttttagtagagacggggtttcaccatgttggtcaggctggtcttgaactcccgacctcaaatgatctgcccaccttggcctcccaaagtgctaggattacaggcgtgagccaccgcacccggccaattttgtatttttagtagagatggggtttcaccatgctgctcaggcaggtctcgaactcctgacctcaggtgctccacctgcctcagcctcccgaagtgttgggattacaggcatgagccaccacgtctggccttttttgttatattataatttaacatatcctaaacattttctcatcattaaaaagttaacataaacattttattcatatataatatttttatctacttttttttctttagagctctacttctggaagaatctactttttgatttgtggttctgaaattatagcaaattgtgtaatttatcatattttatcacaggctagtatgcattactgattcataccctgtttgcagcttttctcactctgatgcttgtgttgattgttttttccagcagtgcagggtagattatcaactggcttataatcagaagagcttgcttgtatcacagtgagttatacttcactgatttcactgggaaatcttacttcctgagtttccatggttaaagatttgtaatgctcaaatcttcttttgatgtttattccatcagagaaaacagaaactactttgtcttagtgttgccaaattgaaaagagcctttggtttggccaggatctttgtgatagtggcacctggcagtgtcttccctcctgaggagcatccgtgctcacttgagcctctctgatcctagtactgcctgtcagaggcagctggtccacctgagtgccaagctggcgctcctttggagtttcagctgtactaacttttgcttagctgtgaggaatcaaggattttgcttttgcagggggaatttttaacctgtaaactaaactcgcttgctttgaaaggtttactagattggcagattattagtctgattattagtccagtcatatctatctttcaacagatagtttggccatgacttttttttttttttgagatggagtttcgctcttgtcacccaggtcaatggtgtgatcttggctcattgcaacctccgccacctgggttcaagcaattcacctgcctcagcctcccaggtagctgggattacaggcacacgccaccacagctagctaatttttgtatttttagtagagacggggttttgccatgttggccaggcttgtcttgaactccttacctcaagtgattcacccacctcggtctcctaaagtactaggattacaggcatgagccaccactcccagccggccatggcttttttctttttttgttttcagacagagtttggctcttgttgcccaggctgcagtgcaatggtgtgatcgcagctcatttcaacctccacctagcaggttcaagtgattctcctgcctcagccccccgagtagctgggattacaggcacctgccaccacgcccagctaattttttgtatttttagtagagatggggtttcaccatgttggccaggctggtcttgaactcctgacctcaggtgatctgcctgccttggcttcccaaaatgctgggattacaggcatgagccactgtgccccgccaacatgtactgttatttatgttttaaaaagataaaacaatgttcagtattttggtggaacaagcttggtactatcctgcattgtatagagtattacaaaagaaaatctttaggtgtcatagtaaaagatgtcccaaaaggtggagataataatcacactgaaatgtgaatagtcatactaggaaccttgtggttggttttgaatttcacactttcaggaggacgtagacgaaatgaagtgctttcagggtgatatgcgtcccagccagggcatatgaagactggttgaagaaatgtttcacacttggttgataattataatagctgtctccagccatgttccagaaataacataagcctgcttatgatgtattttatatttgaaatgataatggcttccatgtgttgatcacctactttgtgccaagtacatacattatccataaccttttctccaaatctttgaaataggtggtattcttcccttaagaatctggataattagactagcttgcacagctaatttatgctgctaatgaaaggtagacctgggattaaatgttgtgctttttgtactataccatactgcctctggcatgagcatgcagtgaggctgtgggtggtggacacttcccctcttctgcttatgatcaggttaattcctgaaatttaaaatgacattgaatagtcatagtagataatattgagcacttatgtgccgtacacctttctaagctctttgcatgtaatttatttaattctcacaactcagcgaagttgttaccattatcgtctccatcctgcacatgaggaaactgaggcaaggggtgtaggtggaagaactcggttttgaaataggctgtccagctgcagaacccacacttagcccctgtactgtttgatttatgtagatgaccattgtgtatacacaagagtgcaagtttttgtttttgtttttgagacggagtctcactcttgtcacccaggctagagtgcaatggcacaatctcggctcactgcgatctcgacctcctggttcaagtgattctcctgcctcggcctcctgagtaagctggatctacaggcgcgcaccatgcccagctaatttttcttcttcttttttttttgagacaaagtctcgctctgtcgcccaggctggggtacagtggcgtgatcttgacccactgcaacctctgcctcctgggttcaagcaattcttccacctcagcttcccaagtagctgggactacaggcatgtgccaccatgcctggctaatttttataattttatttgagacaaggttttaccatgttggccaggctggtctcaaactcttgacctcaagtgatctgcccacctcagcctctcaaagtgctgggattacaggtgtgagccaccgtgccccgctaatttttgtattttagtagagatggggtttcgccatgttggccaggctggtcttgaactcctgactgcaagtgatctgcccgcctcagtttcccaaagtgctggaattatagtcgtgagccactgcacagggttccagccttagtcttttttagcctacaaaatggcaagtttatatgatttaacctaatatagatcaagggaaggatattccaaaataaactattttttgttttaggaaagaattggatgtattaaagttttgtgttttgaacttctccactgacatacttttcctgtccaattatttgtctgagaagtgtgtattctgtttcacatcgtgtcacttttgcttctccttttttttttttttttttttttgagacagagtttcactcttattgcccaagccagaatgcaatggcgcgatctcagctactgcaaccttcgcctcccaggttcaagtgattctcctgcctcagcctccggagttgctgggattatagatgcatgccaccacgcccagctaattttttatatttttagtggaaatggggtttcaccatgttagccaggctggtctggaattcccgacgtcatatgatccgcctgccttggtctcccaaagtgctaggattacaggcgtgagccatcgcgcctggccaactttttcttctcttacctgcaactaattgatctggcatcttttatatctcttgttataggtagaaagtgattttaaggcattatgctttgggatgtgtgtgtgtgtgtgtgtgtgtgtgtgtgtgtataggtttttgttggtttaaattggctctataacagcatccttcagacaaccaaacctaattttgaagtgtagagtataatttagatcaaatttaagagttttaaaattacctctgattatgggatgacacttgaaaaagtaatcataatacttaccaaaggtttaacaggctacctgcttccagtggagattgtgtgattgtgtttacgaaaaatctgattaactcaagaaagggccattcattgcataccgaattcctaattttttaaaaaaagatccatttaatataatatattcttgggtgaccaaatctgtagcataggaatgacttaatgtgattttttgttggtgggaagacattctaaagggagtcctcaataaactgcatttctaacacacaagaggttcttgtggcctgggggcggtggctcacacctgtaattccagcactctgggaggctgaggcaggcggatcacttgaagtcaggagttcgagaccaggctggaccagtctctactaaagctatgaaaaaaaaaaaactggacgtggtggtgggcatctgtaatcccagctactcaggaggctgaggctggagaatcgcttgaactggggaggtggaggttgcagtgagccgagatctcaccattgcactccagcctggacaaagagcaagactccgtctcaaaaaaaaaaaaaaaaaaaagtccttgtgatgggtttactttttgtcattggtgcctgaccgactattgccttctgcttatttgtcttttagggtcatgcttttattgtctctttgaaattgatcattgagtcctatgagtcctccttatgccttccacctccatttagttagctggtttttcttgcagtctctgggtcctttttgttgttgtttgttttgcatttattattattgttattcatacatttttgagacagggtcttactttgttgcccaggctggagtgcagtggtacagtcatggctcactgcagcctcaacctgctgggctcaagggatcctcccacctgagctttctgggtagctgggactataggcacatgccatcatgcctggctaattaacaaaatttttttttttgtagagatggggtcttgctgagttgtctacactggtcttgaggatcctggcctcaagtgatcctcttgccttggcctcatttattattatttttaattgacatgtaataattttacatattcatgtggtacagtgatatttccttacatgtatacgatgtataatgattaaatcaggataattggcaaatctgtcaccttgagcatttatttctttgtgttcagaacattcaaaatctgcttttctagctatttgaaaatatacaataaattgttattaattatagttcccccatagtgctgtagaatgctagaacttattcctcctattctggatccctttttttttttttttttttttttctgagacggggtcttgctctgtcgcccaggctcgagtgcagaggtgcgatctcggctcactgcaaactccgcctcctgggttcaagccattctcctgtttcagccttctgggtagctgggactacaggtgcccgacaccacgcccgactaattttgttgtatttttagtagagacagggtttcaccatgttagccaggatggtctcaatctcctgaccttgtgatctgcctgcctcggcctcctaaagtgctgggattacaggtgtgagccaccacgcccggtgttttttttttgttttgttttgttttttgagacagagtcttgctctgtcacccaggctgtagtgcggtggtgtgatcttggctcactgcaacctccgcctcccaggttcaagcgattcttctgcctcaacctcccgagtagctgggattacaggcatgtgccaccatgcccagctaatttttgtatttttagtagagatggggtttcaccatgttgtccaggctggtccgaactcctgacctcaggtgatccgcccacctcggcctcccaaagtgctgagattacaggcgtgagccactgcacccaccaaatctggatccttttgatcagacaaagtatattgtaaaacaaagtacgtgttgaaatctcaaagactcaatactaaaacctttgtaactgttacactttccttgcacaaaaactgacgtaaaatctcttaggtttcatagagagatactgaggaatgttccctatttccgtccacacagataggtaccaggatggtagtaaatgtaagtctgatccaactcataagtgctagcttgagatccttgattttatttattttatttattttttattttttttgagacagagtctggctctgttgaccagggtggagcacagtggcatgatctcagctcactgcaacttctgccttcgggttcaagcaattatcgtgcctcagcctcccgaatagctagaattacagatgtgctccaccatgcctggctaatttttttgtttgtttgttttttgtttgagtcaaagtcttgctcttgtctcccaggctggagtgcaatggcatgatctcgacttactgcaacctccgcctcccgggttcaagcaattctcctgcctcagcctcccaagtagctgggattacaggcacctgccatcatgcctggctaatttttgtatttttagtagagacagggtttcaccatattggccaggctggtctcgaactcctgacctcaggcgatctgcctcccttggcctcccaaagtgctgggattacaggtgtgaaccaccatgcccagcccatttcttttgtatttttaataaagatggggttttaccatgttggtcaggctggtcatgaactcctgatctcgagtgatccacctgccttggcctcccaaagtactaggattacaagtgtgagctgctctgcttgacctgagatcctttatttttatttttatttttatctttttaaggatttttccttaaagtatatgaaaccctgaaaacttgtacgactgtttaaaataaacatgttgatttcttcttcctaaagatgaatcacaattgagtcttatttgacctgaagttgttttcattctctctaaacagtaatttgaggaggtaatggcagtctgatgtctcaggctacatttgcacgctagtctttcaccctcagttgtcatgtgttaatgcatgttttgtaataactgggataaatacaaggaacctttgcttttgtttttatttttttcagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaagtaagtatcttcattcttcattgtgtcatggatggctcagttgcttggccacagtgcttgtgttttctgacacacaaagcaggcattaggtttgtctgttccagttgaatcccacaggactgaacatattaagtgatcctctgggctgtgccacggagctgtggccttcctacaggaagcaggaacacctaactgagaattaccttgaaaaatcgcttagcctctgaaggccttgctgcttccagtatgagtggggacagtcaagcaaagggaccttattcagaagccagcaggagaactcgtgctcagagcagcatgggtgccatcgtcccactctcccaaacctgtgcgttttccttgccagcagcacaaaagagcacgataaccaaaaggtgatatgtgattctactgctgggtccaaatgtgaatcctgtttcatcttaagtgcaactgaagatatttataatagcactgtttgttttgcatagaaaccataataggggttaccataaaatctcattttataacttattacagagaaccttttaggaaatatcttctaaagcttacagaaattgaaaaattacatgtttccaggggaatttcagaagaattaatggatttccaataaattatataatcttcccagctttttacttgctattgtaatatcactacctacttcttggcttagaggttttctattaaaatgtgtaggtcttaaatggtatatggaactcctaggacatctggcagtgttcccagtagagtatacaatcaggtttcaggacaggggcagagccatgcagactaaggtgaactctgaccctccgaggggtcaaccttcatttatgctgtcaagactttgtatgtgctgtattatccattaaaaatataatgtgaggccaggcacagtgtctcatgcctataattccagtgctttgggaggccaaggcaggaggatcacctgaggtcaggagttcgagaccagccttacttaacatggtgaaaccccgtctctactaaatatacaaaaaaattagccgggcttggtggtgcatgcctgtaatccgagctactctggaggttgaggcaggagaattgtttgaacccaggaggcagaggttgcagtgaaccgagatcatgccactgcactccagcctgggcgactgagtgagactccatctcaaaacaacaaccaaataagctagcataaactcatgcagattgtatggttctgcttatataaagttcaaaaatgagtaagaaaaataatctatggtatttgaggtcaggacagtagttacctttgggaggaggtgggtaggactggaaactgggcaggagggagtcttctagggctccgaaatgttctgtttcctgatctgcatggtggttatacaggtgtgttcatttatgaaaaagtattggtttatgtgtttatttgtgtgtacttttctgtgtatgttttatgcctcaataaaaagcatgcttaggcggacatagtggctcacacctgaaatcccagcactttgggaggtggatcgcctgaggtcaggagttcgagaccagcctggccaatatgatgaaaccccgtctctattaaaaatacaaaaattagccaggcgtggtggcaggtgcctgtaatcccagccactcaggaggctgaggcaggagaatcgcttgaacctaggaaacagaggttgcagtgagccaagatcgtgacactgcactccagcttggatgacagagcaaaactctgtctaaaaaaaaaaaaaaaaaaagtgtgcttaaaacatatacttggaaatggtaaaaatgcagtaagaatgtaagaaactgcagagagataccaagataaaggattgggctttttacttgaaataatgaatgtaattgagaggattttaatgtttgtttgtttccttttatctgacttacctccaaattaatctccttttcagtcccatggcactaatctaggtttcttctcttgccctggttgttgtggtcatttcttaatcagttttcctcccatcattctttactcactgtggttatccatcattttgccatcggatcgatctttaagagtacagacctgattatatcactctcttgctaaataatatgtaaggacagaatgatgcttctgcaaagcataagttttggagctgggcacatgggttgtgaatcccatctgttgcctcagtcactgttggactctcttcaggtctccagacctcactgtctctgagtgtaaacctgagttcttgtgattagtttgtgagctaatctttttaataagcctgtgtaaacctgagttcttgtgattagtttgtgagctaatctttttaataagcctgtttcaaggcctggtgtggggaagtggatttccttcttccccttgctttctagaatttcatccttctcatccagccatatgtggctgagttgggtacatttgtgtgagctctctagctggattctgagtgctgttggggaggaattatgttgagtcatcttgagtcactacagtatcccatgggctctgcagcactgtagaaacaaccagcactgaaggactggagattatgttgagtaaatggaggtcattgaggtgtcaggagccagtagaaatagcaggtgctggatatcgtaatggattgacatctgggcaggatgagggtacaacactggaagtagagtgcagcctaccccagacagcacaaagccaccagagttaggttgttccaaaggctaaggcttgacaggcaggaggccattgagggacccatggaagtcctgcttgcctgaccatcgtggtgtgtgctctctgtgctaggacatagtgcctctgcctctccctgttcatggtaattgtctgaggagggactttgctcagtataatgcacctgagcgtggggcaggtattcctggccagatgctgatctaccacctggctttgggattcttggttaactgtacttgcatgacttggtttatgttgagtaatatgtgtcagctcacctgagtttgaatacaggctctaccgcttgcttgctccaggaccttgggcagagaacttgcgaaacttcaattttcccatctgtgaaatagagataatagtactacctacctcataactttgttacactaaatgacccaaggggaaatgctttgtaaaatgtctggcctataataaactctgaatacacagtctctttatctcagtgaaagcatttacccaggcagtcagagatctgagttctgaactcagccaaccactgatgagctacaaaaccaatagacaagacattgccattttggtataattaagaagcctgagtgactgattttcttttcttttttctttttttttttttttgagtgattttcgtttcctttcctttcctttcctatcctttcttttttttttttttttttgagtaattgattttctactttcatgtctccctcttgggtctcatgcattatactgacctgggattttattctctctgttaatactgaaggatccttttcaatgggatttggaaatttcttggtgaattggagatttttgtttaccagtttttaaaaataaggcctgctgtatactcactagactagtagggttggacaattataaaatgctttaagggaaacaagagtcttttaaatccctatgctttaacttgttgccaaaaggttttttaagtccttatgttttaatttgtttaaagtggtcctttgtaaaattgatcaatttagcagcagaatgtgccacacagaccactcacccactgtttgatcatttctgtaccctctcagtgagggcacagtctgatcatttctgtaccctctcagtgagggcaggatttgtgcagccaggaaggaatgtacccccatccacatgtcaagtggacacagcctcctagacaacatggcgattacccaaatgtatctcccatgcctcattgctgatacgtttagcagttaccagaccgaaggaactagaccatccatcttgctgtgatccagatggaaaattgaaagcctggccaccagccctgactgtgccactaaccagcaagagcctcggtattatcatatgtggatggggctcagtagacatgttcagtgtttatcacgtagctggctatcaatgagagtgaacatagtagtgtatgctgaagattctgtagtgtggctgccttattctgctgcagctctccagaaggcacccctgttccaggcatcaccccttacctttctcccatcaaagccttgccccagtttgtcagggttttactggatacttgactaatctgataaccaaaaatttgaaagaatagaaccaacttaatagtattgtggtttcacctcaggcttctgagaatgctcttatcagggtggaatttcagacagtgtggggagttcagttggggagacgtttcactgggagacgtttcacagtgggactctgataccaggcagcctgtgttttagtttacaggcagtgtgaacttgacattctgcttaagtgaaaaacagaatattataggatttgtgctgcgtgataatagtaactgtaaaaaagtaccccctttatgctgaatgctctgatttttttttttttttttttttttttgagacagaatctcactctgttgcccagcctggagtgcagtggcgtgatcttggctcactgcaacctctgccttcggggttcaagcaattctcctgcctcagcctcccaaatagctggtattacaggcattcaccaccacacccagctaatttttgtatttttagtacagatggggttttgccatgttgtccaggctggtcttgaactcctggcctcaagtggtcccgaacttgggttctcatggatttctctgatggagattcctggggcttccagcaaaaccactgggactcgaaagtaccctgcagagatttcttggctttggactcctcaatatctgggttggtaaggttgggcagaagtagtagttctggtctgagagtccgtagactgatcttagtagcaacctgccactgttccctttgtgatctcaggcaggtctcttcacagatctgatttcttttctccttccttccttccttccttccttccttccttcctttcttttctttctttctctttctttttttttgtttgtttgagatgaagtttcactcttgttgcccaggctggagtgcaatagtgcgatcttggctcaccacaacctccgcctcccggattcaaatgattctcctgcctcagcctcccgagtagctgggattacaggcgtgcaccaccatgcctggctaattttgtatttttagtagagactgggcttctccgtgttggtcaggctggtctcaaactcccgacctcagatgatctgcctgccttggcctcccaaagtgctgggattacagagatgagccaccgtgcctggctgatctcctcatttctaaagtgatgatgtagagctaggtatgcatgagaccaggccctttcatgtggggagaaaagctcataaacaacgtgagaaagctaagttctgtgttaggaacatgtaaagtgctgtgggaacacagattcagattttgcctgtagggtaggagctggactgttgagaggagaaggtgacatttgagttaggccttgctgtgaattgaattgtgtcctgccttcctccctaaaattcatctgttgaagtcctaaccctcagtgtgatggtatttggcaataattaagtttaaatgatgtcatgaggttggggccttcatgatgggattagtggcattataggaagagatcagagctccccctatccccccatgtgaggatgtagcaagaagatggccatctgcaaactgggaagaggggcctcactgggaaccaaatagtctggcaccttgatcttgtagtttccaacctccagaactgtgagaaagaaatatctgttgtttaagccacatataacataatgttttgttataacagcctgagcagactaacccacgccttaaggagtgaggctagataggaattggaccagaagccgggaagaggaaaagcatccctgtgccaggaataggcatagcaagggttcagaggcatcaaggggaataaaccaatcatctgtccctaaggtgccccttctgatgccagccttctgtaatcctgtcactcatatggttcttctgctctcagccaagcctttagttgcaaaatgaatttagaaggtcagtttagatttgcttttccaaatgaggtttctcagtataccagagtcacttaataaattctcttccagtagccagctcaggctcccttgggtttctttctacttaggtgagttcagtcctgaatacaggttaggctcagaaagaattttctagtgtcaaagagggcctctcctgtgcttattattacttattgctacatctgtttgagtcgtgctctcaccctgggtaaacctcagttttaggccaaagtgagccttggggcactggagtgggcacctcttcattgccatccacaccttttctcatgggactacactggccttatcgcaggaacatgtcctcctccccttaaaacaaaaagagcagtgtgagcttaattagaatatggattatagtgccataacagagagaacaacatagctggctaaaatcagagaagtttatttccctctcaggatgaactgcaagttacccatggtggctgtgctcaggctctgaaggtccccgggccttgctttctccccattgttccaccaggctctaaaggtccctgggccttgctttctccccgtttttccaccaggatctgaaggtccctgggccttgctttctccccgttgttccaccaggctctgaaggttcctgggccttgctttctccccgttgttgccccaggtgctgctcttctttggtgtccaaaatggctccctgccttgcttatctttcagctgctgggaagggaagtgaagggaaagtatgctcctttcttttaaggcacaacccagaagtgccacacatcacttcttgtatccgataggcagaacatctgccacccctctctcaagggaacatggaacatgaactcttcctatggaagaagtggagaaatagtgttgggaagggcactgcagcctttaccacatgagctaagaagaatgcagggcttgaggagggaggggttattggagggccatcctgggttggtatctgggtgggactcatggtaggggactgataggagatgagattgggaaggtagacatggtgaaatgacagtggcagaccctgactaccacttctctgataggcagagagaacccctccaagcccatatctgcttctgtctgcccttgagctaccacccccttgtgcagatcagaacatgctctggtcagtgcttgtcccagcctcgtggctgagctctgtggtgtacaagcagttaccccataggtggtggtgatgctattcttttccctcctggaagcggcggtctgatgacagttgtccctctgctctcataaatcagtgactggatggaatactcaagagtcagctgtatggaggagcaagagggcctctggtatttctcctgatggacacctgcagcttggggagaggacaagtggccatcctggaggaaagcctcaccctgcttaggtgacaagctgctctctgatccagagcctggcaggaagtcactctttgtccaacctagtcagggcagccgggaggaagctccacagccagtacatgctctgtgggtcatggaacaattggtaaagctgtccagagagagagttgacagcagaccagcgaccagcactgctttccagggaaagaatattgcaagcaagataataacagctgacatttgagtacttcatgtgctgggcgctgttccaagttcgttacttgtattgtcttatttagttatcagaacaaaccctctgaggtgggtgctgttatgcctaatttatgcagttattccactgtggtctcagagtgtggttgatatgatttcaatgatttgaattcactgatacttggtttatggccaagcatgtggtcaattttagattatttgccatttgcagatgggtggaatgtatagtttgtcattgctggatttaagtccagtatttctttgttttttgcctcgatgatctttctaatgctgtgtcagaggggtgttgaagtcccccactaaaattatgtgactaagtctttctttaggtctggaagtacttgttttaagaatttggatgctctaatgttggcatattaggcatctataatgcctaatttatagattagaaactaaggtgcagatgagatggattaatttgaaccaatatttacagctctagcaggtggtggagccatgatttgaatctgttgtgaagcccatactctcactttgaggctctgctgtcttttatgattccagggaagagtgcctgtcccaggccctggagtgggagataggagtgcctccctgcaggagacttcctgtgcacctggcagtctggggatttctgcctgttgtcaccttgtctactcctgttcctcagggactcacctgccttagctcagtccttgctgggcaattctctgtgtcttttctagggcctgcaagttctgccactggagtttacaaatgaccactatctttagccagataaccaggtatgccctagcattgggcagttttcctctacatcttgccctctctgtctcaaggatttaggacctagattatgttgctgcttcaggcagttctgctgctgacaagataaattctgttagcatttcactaagctgatgggtataattactttagttggaggtcactaaaacctgaatttacaaataaaaactggatcagggagcagtctgtgtgtgtgttgtggaggagtgtgggtgaaggtacaacagataatatccctcctttgctgagatccttccagtggctccctaaatcactcatagtaaaagccaacttcctcacagggcccttcatcatgttctgctgctagcctccatctgcttctttcccttactcaacctaattctaatttcagttccattggagccatacagatctccttgctatttctttatttcaaattccagttattcattgctggcatatagaaaagcaatagattgttgtatattaactttgtgtcttgtaaccttgctgtaagtgctgttctggcagtctttgttttgatcaattctttgggatattctacatagacagatcatctgcaaacaaagatagtgttatttcttccatttcaatctgtagagcttttatttccttttctggcttattccactcgctaagatttccagtaaaatgttgaataggagtagagagagaggcaccttgctttgttcctgatcttaaggggaaagcatccaatttcttaccattaagtatgaagttggctgcaaagaagttctttatccagttgaggaaattccctcctattcatagtttgctgccccatcagctttttaggttggtgcaaaagtaattgtggtttttgctgtgactttcagtggcaaaaacagcaattcttttgcaccaactgaatagaatgtagctctgtgagggacagggggtgttatctgtctttgttcattgcaatatccctcctccctagaatgtgcctggaacatagtatatgcatggtatctgttgcctaaatgaattgaaaccatggctaataatacggtggtagtcaaactgtgtaaaaatgagttttgtttttatgtttggggaagaccctgttctcaggatcaatgaaaagtaaaaatgactgatagcttttttgaaattcagaaggcatctgaccatgttttgccagtctgctgtctttgggccttgggtttttggttttaaaaatgagtgcttttacaaattggtctaagttctctccagctttcatgtttgttgactttctttctagttgcagggtattttaaaagttaaggagctcaaatacccttaagtcctatgttctctagccagtagatcaactctgcctatagattccaggcttgccagccagtaggcacagcccactcttcctttctgatggttaccaagtgctaatttgggagaggggcctgggttgcagaggagacatggtgctggagagtcagaccaatttgcttttaaatacctatgtgatgtcaggtgggtgatttcacctctctgagcttcagtttcccggcctgtaaaatgggaatgatatacacacaagttgttgtaaggattaaatgagatatttgtggtttccttgcacacaagtgcttagttaaaatggaatctgattgtctaccctgcctcacacctgctttgtggatatcttgattccatatcagaatcacttggaaagttttaaaaatcctgatatccttgaaaacatcatgctaaatgaaagaaaccagacacaaaaggtcacatattgtatggttccatatttatgagatatccagagtagataagcccatggagtcagatgcaggttggtggggctgaggggaagggcttaggggaggggaaatgctgcttaatggtaaagggttttactttggagtgatggaaatgttcttagaactatatcaaagtggtcgtacaacattgtgaatgtactaaatgcaactgaattggttgtttttctttacagctgtatcgagacttaattgtacaatgaactacacatatttaaatggtataattggtgagatttgacatatgtttatacccaactatcaccacaatcaagatagtaaacatattccattccctcccaaactttcctcatgcccctttttagttcctccttcccacctctcccctccccctgagctccaggcaaccactattctgcttactgttacttgtggtgtgttttctctcttttttcttcccccccgagatggagtcgctgtgttgcccaggctggagtgaagtggcacgatctcaactcactacaacctctgcctcctgggctcaagcgattctcctgcctcagcctcccaagtagctgggattacaggcatgagccaccacacccagctaatttttgtatttttagtacagatggggttttatcgtattggtcatgctggtcttgaactcctgaccccagctgatctgcctaccttggcctcccaaagtgctgggagtgagccagcatgcccagatggtttgttttcattttgcagactattgtagaaatggaatcctgcagtgcgcacttgttttgtctggctcctttcacccagcatactttgagattcacttatgttgctgttcgtacctttttttctatttttattttttgagacggagtcttgcactgtcgcccaggctggagtgcagtggccagacctcagctcactgcaagctccgcctcctgggttcacgccattctcctgcctcagcctccccagtagctgggactacaggcgcccgctaccacgcccggctaattttttctgtatttttagtagagacagggttttaccatgttagccaggatggtctcaatctcctgacctcgtgatccgcccgccttggcctcccaaagtgctgggattaccggcatgagccactgcgcccggcctgctgttcctacctttattgctgaaaagtcttccattgtgtggatacatcatgaattatttgtacattcacttgatggacatttgggcagttttcagtttggggcgattacaactaaaactgctatgagtcttcatgtataagtctctatgtggacgtaagtgatgctttctcttgaatgaatatgttgtagtggatggcaaggtcataggatatatgtacgtataaactcttgttgatatctaaaaagtaaggcatggtgaattacttgaaatcctataaatatatttggtaagagaagaagaaacgactggatttttttgtttgtttgttttggagacagattcccactctgtcacccaggctggagtgcaatggtgcgatctgggctcactgcaacctccgcctccccgattcgagcaattcttctgcctcagcctcccaagtagctgggattacaggcatctgccaccacgcctgactaatttttatatttttagtagagacggggttttgccatgtgggccaggctgatctcaagctcctgacctcaggtgattcacctgccttggcctcccaaagtgctgggattacaggcatgagccaccgtgcccggctacgactgaatttttctttctttcttttttttttttttctttgagatggagtctcgctctgtcgccaggctggagtgcaatgacatgatctcggctcactgcagcctccgcctcccgtgttcaagcgattctcctgcctcagcctcctgagtagctgggattacaggcacacaccaccagacccagctaatttttgtatttttagagagacggggtttcaccatgttggtcaggctggtcttgaactcctgaccttgtgatctgcccgcctgggcctcccaaagtgctgggattacaggcgtgagccaccgcacccagcaatgactggatttttcaatggtgaagctattaattttgaaaactgatctcagtagagtggtaggtgggaagctttttagaatgtaattaggaaaaactgtgaagggagaagtttggacagggaggattgacatcttaaggagttttgttgtagagtagagaggataaagttttggtatttagaaggcatgaactgttcatttaaaaataattttatgttatatgaatggtacctcaatttttagaaaaagaatgaaacaagcaacagaatcctggctggatgcggtggctcacacctataatcccagcactttgggaagctgaggcggctggatcacctgaggtcaggagttcaagaccagcctggccgaaatagtgaaaccccatctctactaaaaatacaaaatttagccaggtgtggtggcgtgtgtctgtagtcccagctactctggaggctgaggcaggagaatcgcttgaacccgggaggcggaggttgcagtgagctgagatcgcgccactgcactccagcctgggtgacatggcgatgaaaacaacaaaaatcagatccccaggtgattccagtatgtagccagggttgaggagcagtgatctaagtagagttttgcaaacttgtctgtaaagggccagataataaatacttttcaaccttggggttgaaaggtctctgtcctcacttttcagctctgctgttgaagtgtgaaagacacgtaaccaatgaacatggcatgtttcactaaaatccatttacaatgacgggccatgggccagagtgtgctgagctggactgaaaggctaagtgatggaggcgtggctctgcctccagactggagcaatctgctccagacttcccaggcagagccagacccatcggacatgcttgcttaggagaagaataagcaccccagcattgaaaacaaaatgttaaaatgccaacatttgtgtttaattctagctacaaaagacaaggaaaagaataaagagaagaaattcaaggagtttgtgagagtgaagccaaagaagaaaaagaaaaagaaaaagaaaaccaaacctggtaattttttttcctgagggtttcacttaggtttccttactatgaatggggaggggttgctttctcccattatggcctctgggcctgcgctgagcagaggaaggaccaatagtctcttaccagggcttgtgggctcaacctagtatgggccctggaaggggaggcatccactcacccaggtgttacaaagtcctgctggcattgaaaagccttctcacttgctgccttggccagtgtgccctgctgcaggatggtacagatgaaggcatcgaagtgtaagcagatgtgcaggtgaatgatggtatttgttcacacacacgactcttaaaacacatctttgagccctcttgagaaaggattcccttcttaaaaactgtgtctagccctcacaaaaatgtttagaaaaatctatatattctgacttgggacttaaaggatgccacgttttattcttggtgtatcttctagcttagaaaaacaatcttatcagaaaaagaggagagggtcaatacttaagaggaggtgtttgggccccttcatctgctctccacacctctttttggttgaattgtccctgagcctttgtgctgcttgaaaaggaggcttgttggttggatgagattgattctagaatgcaccagtgttaactagggttattcattccttcctgatcctgttcttccagaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattgggtaaggaggctcttctgtcctgatcatttgctgatcatttattggaaaatacaagcatacctgggagatattatgggtttggttctaggccactacaataaaacaaataaagctagtcagacataatttttattttcccagtgtttacaaaacttatgtttatactatattgtagtctcttaagtgttcagtagcatatgtctaaaacaatgcatataccttaattggaaaatattgttgtgttgagaaatgtcaagttttttggagtaagtcctcaaaagcatagacaataaataaagaaatggacaagtgggattgcatcaagctgaaaagcttatgcacagcaaactaaacgattaatagaatgaaccgaaaacctactgaatgaaagaaaatatttgtaaactattcatcaacaagagattagtagctggaatatataagaactcaactcaatagaaaaattattcaatgtaaaaattggtggccaggcgcggtggctcacacttgtaatccctacactttgtgaggtgaggcaggtgggtcacttgagcccagaagtttgagaccagcctggccaacatggtgaaacccatctctgcaaaaatacaaaaacttagccaggcgtggtggtgtctgccttgtaatcccagctactcgggaggttgaggcaggagaatcgtttgaatctgggaggcagaggttgcagcgagccaagatcatgccacttcactccagcctgggtgacaaagccagactccgtctcaaaaaaaaaaaaaaaacagtaaaatatgttatatatatacatatacatatatatatgtatatatgtaaaaaaaaaggtaaaatgttttatatatatatatatagatatacacacacttacacacatatatatatgtgctcaacctaatatgggccctggaagggaggcacccactcacccaggtgttacaaagtcctgctggcattgaaaagccttctcacttgctgcattggccagtgtgtcctgctacaggatggtacatatgaaggcattgaagtgtaagtggatgtgcaggtgaatgatggtatttgttcacacacacgactcttaaaacatatctttgagccctcttgagaaagggtttatatatataatttatattttaaaatatatatatatattttgttttgttttgttttgttttgctttgtttttgtttttgagacagagtctcactctgttgcccaggctggagtgcagtggcgcgatcttggctcactgcaacctctgcctcctggattcaagcaattctcctgtctcaacctcccaagttgctgggattacaggtgtacgccaccacgcctggctaatttttgtatttttagtatacacagggtttcaccatgttggtcaggctggtcttgaactcctgaccttgtgatccacccacttcgacctcccaaagtgctgggattacaggcatgagccaccgtgcctggactgttacatttcttaaaactttctttgaaataaaattagtttagttattccatatgtcctgaaaaatgtgacatatgtgttcattagatcaatcttgttttgatgtaatgttcaaaaatttgaactagcaatacatttcattatgttaactgacaatttaaaaaatgaaagctgggtgcaatgtcccacacctgtaatcccaacactctgggaggctgaggcgggtggattgcttgaccccagaagttcaagaccagcctgggcaacatggcaaaccttgcctctacaaaaaatacaaaaaaagttagccggttgttgtggcatgcacctgtaatctcagctacttaggaggctcaggtgggaggaacacctcagcccaggaggtcaaggctgcagtgagctgtgatcatgccactgcactctgggagaaagaatgagaccctgtctcaaaaataagtaaataaaataaaaataataaaaagtaaaacaatattttattgcttaaaaatgctgacagacacaaagtatttgcttttgcaataatggtgtcagtagactttcagggttgctgccacacaccttcaatttgtaaaataatatacaatatctgtgaagtgcaataaaatattaatagttatgcctgacttagaacagtatctgcttcagaacaagcgcttagtaaaagttagctgtgattataactaatcaggcatcaagtgattctgcctctgattatccctggaatcttcctcttcctcattcctcactgtctatagagtttttgtttttgatttttgtttttgagacggagtctcactctgtcacccaggctggagtgcagtggcgtgatcttggctcactgcaacctctgcctcctgggttcaagtgattctcctgcctcagcctccccatagctgggattacaggcgcacaccaccacacctagctaatttttttgtatttttagtagagacagggtttcaccacgttggccaggctggtctcaaatcctaggctcaagtgatcggcccaccttggcctcctaaagtgctgggattacaggcgtgagccactgtgcccagcctgtttgtcttttgagacaaagtctcacgctgtcacccaggatggagtgcagtggtgtgatcatagctcactgcagcctcaaactcgcaggctcaagggatcctcctgcctcagcctcctcagtagctgggactgtagacgtgcatcaccgtgcccagctaattttttttttcttttagtggagatggggttttgccatgttgcccaggcttgacttgaactcttgagtgcaagcaatcctcctccttcggcctcccaaaatgctggtattagaggcatgaaccaccatgctcagcctttgtttacagagttttaaaggtagctctggatacagacagactgtaagccaggtcctgactggatggagtgaggctgaagaacatgttagagttgtcagggatggtggcctgtgtggttcatggggagttgtagctcctctgccactgagttctatgatcttgagtagccactgccgttgggcttcattctctcagtgaaatgaggaagtggagttgagttcactgccaggcagcatgcttcgtttgggctgttactaaatgacagatccaaggacagattggcatcctcgtttccttgccctatgaatgttcttgtttggaggtatgggactataatgtcatttttcattcttgacaatcaaaggttttttaattttataacctaaaatagtaactgttgttttccctttcctcgtagaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcaggtaggcagagcttccaggaaacaggtctagagaagcacaaactggtccttggagggaattttgaggccagcaacaatggcaagtcatagcagagccccagaaacacagcacgaacggcagcagactgagcttctctttttcgtttggcttcctcagagttccaggctgccatacatagtccattgatggagtaagagaggactttagggatcactgagtctaaacctctcatgctctgcttgaggcagctgggacccgcaaatgggaagggccttgcctgtggtcacaaagtgaggagttgaacagcagggactgaaatctttggagtggcagtttaatcttcccatggactcttatcttctctttgaggtaaattttctttaagatccaaagtcatgcaggctggctttataacttctatgtttctttttctttattttcctgacatttgagtctgtcatcttcatctctgagatgtgcctgtggtgggtgggacctccttacctgcttggggaaaccatgcctggccagcacctgcctgccctgtcccttgtctgtaaattgcagttctgggagaggtggcgctggctggctggctcctaagggtgtcacaagttccctgggtgtcttgacagctgcccaactggcttgggaagctgagtttttaaaagtcatggttatattggttaggatttttttttaggggcaagtacaaatattgttgggaaaatagactgggtcctagggctcagaggcagggctgctttcaggctcagaacctggaattccatcttgagggccttggtctgccttgtttcctgcttctctggagtccttttggttcttttttattttattccttgcttattttcttggaaaatgcaaaatggccacctttggcctcgccccaattttacatttttgtgttcaagaggctaggtagaccaaggtcagaatcttagtcccagttctaaatttctgagtaagtaattccagccaaatttagatcagatattagtttttggaacagtcacctgtggccagaggggaaagaggtttgttatggatcaaatgctctcccctggtctagttgtctgatctggtggtagtagagcttacagattatcgacaggggcaaaaagactgcctggggcccacctgtgttatattatagcgttaatgggggttcagggattgttcccagtaaagggggtggctgcccattgtccaataagaatctgtatagcctattgagattatgagaaacaggcccagcccctttggcttgctttctgtgatagaatattatttccttgccctttcagtactgtaggttggcatggcatgggtttggttttttttttctttttgagacggagttttgcacttgtttcccaggctggagtgcaatggcgcgatttcggctcaccaccaccctctgcctcccaggttcaagcgattcgcctgcctccactgcccgagtagctgggattacaggcatgtgctaccacgcccggctaatttttgtattttcagtagagaagcggtttctccatgttggtcaggcttgtctggaactcccgacctcaggtgatccacctgccttggcctcccaaagtattgggattacaggcgtgagccaccgcgcctggcaaaatatttttgttatggtaatttttttttttttttttttttgagacggagtctccctctgtcacccaggctggagtgcaatggcgcaatctcggctcactgcaacctctgcctcccgggttcaagcgattctcctgcctcagccccctgagtagctgggactataggcgcctgccaccatgcccggctaatttttgtatttttagtagagacggtgtttcaccatattggctaggctggtcttgaactcttgaccttgtgatctgcatggcatggatttttgaaattcacttttggatcttgacttaatatacagttacattttttcctctcatctttgaatttgttgtctttatactcaacaatcccctttccttttatttcttgaaacattgggacttttccgtagctctttaaactttcagaacaactagagatgagtagatgtatttgcttttttgccttttattttcccagggcttttagaaaacacttttattttgaaataattatagattcacaggagattgtaaagaggtgtacaggagagtcccatgaattcctctgctggtcttcctcccatggcaaaagcccataaacccacagtaggatatcaaaactacaaaaccatttgacattggcataatcactagagcttattcagattttatcagtgatatacacatactcatttgtgtgtgcatatagctctgtgtgctttcattacaagtacagccttgtgtaatcactcccgcaatcaaggtactgaggtatactaagaccatgagattccctcctggtacccatactttgtagccatacttatccctaaccctggaaacactaaactgtttcaactgtctataattatgtaatttatgattcttggttaatggaatcacgtggtatgtatctttttgagagaggccttttttactctgtataatatccttgagattcatccatgttgttgtgtgtttcagtagtcatttattcttattgtccggtagtattccatgctatggatgtaccacagtcgtgctctttttgttaatagaactaaagcaactctatggagctaaggtaactgggtacagctgagtagtgatttaaagtttctggagtgttttcagaaataccatctcacctctaacaaggcgatctcaagtcacttatttgggaaaacaaaattacgaagatatgatttctttcattgttgtagaaccattaaataagtcatcagattatgatttgaacccagggcacccagtcaagtgctctttccctatgcggccttagctacggggatttacatttacagttgagaagtgaaacaagaaaaatttgtttttgaaacataatagtaccatctagcctggctgaccaacccttccccagcaccaccagtggacatgcgcatgtacatacacacatacatacccacactttaggctgagggagagtcttgtctttttgaatagccttcatagtaacctctgggattcaagggtacctgatatttaagacctttattaaaccttggttcagtggttttcaaacatttttgaatatcagaaccccttttcctaatggactgtttcatagaaccccaaaatgtgtaacaggtaacagcaatagttttgaaagttcaaaatggataatctttacttgtgaggtcggacatgtgaatggtgggcatattcccatgattctaatatgctgtcagaattatgagtgacagacagttgctgacttggagcacttcagtggctcatttgtttttctctatttggttatacaacagtgagacaagcgtgatgcacatggccattgtcagggtgacttttcctgaacagcatgctgtgtagttactttgattaatcagagatgggaggacaagctccgttttgaggtcaacataatactgagctatcctagcaatacaaaattatgtgtggtggcgggcttcattgtcttaacatatggcttggaacatgtttgagtgtgcatctttttttttttaattgtcctaccttaaaaacacacacattttgcagactctctgaagccctgtggactactattagataattgttggttgggcatgctgtaatcccagaattttgggaggcagaggcgggaggattgcttgagcccaggagttcgagaccagccctggaaacatagcaagatcctacctctacaaaaaaattaaaaaattagctgggcatggtgatgcatgccagcagacccaactactccagagactgaagtaggatgatcacttgagcctgggagttcaaggctgcagcgagccctggttattctgttgcactccagcctgggtgacagaatgagaccctgtccccaccctcccccccaaaaaaaagaaaagaaaaaaaatgttatataacatgaagactatcattttttagtagattttttttaagtttgtttttaaaaggatgttgaagatctttagtttctactctgtcatccttgagcatatgctcagttccaggccttgttagtctgacagatttgccctttatctgcctgttaaaatcttcagtgggtgagtaatgaatgtccctcctggcagggctattctgtctaacagtatgtaacccatttctgatccactctggtactttctctattgacttttctataagtagcaaggatcttggtgtgtttgagggtagaggttaatatgccattatgtgctatatgaagaaactaatttcggggcaattggggccaccatgagcatggcagagtcaggagccaacttgatctcctgcttcccaggctccacaagaccttgtgtctcaagctcacttcagagcttcttggcttttgttccagaggacttttctgtgctgtccacctgaaccaagagtgcccacctggctttgtgttaaggagggacggtttctgactgtcctgtcactgtgagcaacgtaccttttctactcaataactttatcaaaaggcataagtttagagggagctagctagaacaaatacagtttaaacttttaaaatgtattcaccatctaattaggaagacaggaataaatttttcttaaatctttaccttaaattgatattttgaataaccctagaatacatttagagtgtgttttctagaagtgcatgtattactatagagaaataactttttggatcattgtcattatatgagtagtatcaacattgttcatgtatatcactattttatcttatttaccagtgctaatttaaatcactggaaggttaaaatcctacttaataaatacggtatttgagaaatctggctaccacataaaaatgaacaggaaatacatttgatatttaaattattttaatcgctgtagagcatgttttgttaagctttttcttaaatggctagataataaatttttaggttttgagggccatatggccttgttgcacctactggattcttctttgagcagctgtaggcaatatgtaaaacaaattttcacctgtatggttggctgcagtggctcacatctgtaatactagcactttgggaggctgaggtgggcagatcactttaggccaggagttcaagaccagcctgggcaacgtggcaaaccctgtctctacaaaaaatacaaaaattagttaattgtgatggtgcacacttgtagtcccagcttctcaggaggctgaggtgggtggatcacttaagcctgggcagtcaaggctgcagggagatgagattgtaccactgcactacaacctgttcaatagagtgagaccctgtctcaaaaaacaaacaaacaaaaacccctaaacaaatgcgtatggctgtgttcacataatactttatttacaaaacaagtcaagctggcattggcacatgggctgtagtttgctgacctttgccctacaacaacaagtattaatatgtattaagtgtccaactccagtaaagattttatagcagttttaaaaagaagcccattttaatggcctagcactgtggctcacacccgtaatcctagcactttggaaggctgaagcggaaggatcacttgagtccaggagttcaaaaccagcttgggcaacatagagagaccccgtttctacaagaaattaaataaaaattaagtaaataaaaatttaaacaaagaagcccatttgaaagttttggttattttaaaattcatattatttgttggtacctaatgcactgacataattcaaagtccagaaagcacacagagaaataccttatccccaccttatccccaactacccattccgtagagtcagcccttatcagtttcttgtatatccttccagaaacattctatggctaaacaaacaatagcaaatgtattgtttccttttaaaaattttttggtaaaatacacataacattaaaagttaccctttttatttttatattttcctattttgagacaggatcttgctttgtcacccaggatggagtacagaggcacaatcacagctcatggcagcctccagctcctgggctcaagtgattgttccacctcagccttctaagtagctgagactacatgcacacaacatcacaccttgctaatttctttaatttttttttgtagagatggaatcttgctatgtttttcaggctggtctcaaactcctggcctcaaatgacccttcctcctcagcctcccaaagtgctaggattacaggtgtgagccaccctgccctgcctaaaagttaccattataaccatttttaagtatgcaagtcagtgatgttaagtacattcacattgctttgcaaccatctctttgtctaaatgcaaatgtttgcattttatgtatagtattttcttttcttttcttttcttttttttttttttttgcgatggagttttgctcttgtcgcccaggctggggtagtgcaatggtgtgatctcggctcactacaacctccacctcccaggttcaagtgattctcctgcctcagcctcccgagtagctgggattacaggcatgcaccaccacgcttggctaattttgtatttttagtagaggcagggtttctccatgttggtcaggctggtcttgaattcccgacctcaggtgatccgcccacctcggcctcccaaagttctggaattacaggcataaaccactgtgcctggccgcatgtatagtatttttaacatcttttttcatttagcaatatgtaaattaaaaaccattttattttctgcataatggttggatcacattttattttactttattttattttatttttttgacggagattcgctctgtcacccaggctggagtgcagtggcatgatcttggttcactgcaaccttcctctcctgggttcaagtgatcctcctgcctcagcctcctgagtagctgggactacaggtgtgtaccaccacacctggctaattttttgtattgttagtagagatgaggtctcaccatgttggccaggctgacctcaggtgaccaactcctgacttcaggatatcctcccgcctcggcctcccaaagtgcggggattatagacaagagccactgcgcctggcccatttttcttttttttaagctatataaatatttgatccacctgaaattttgccaggtatatagtgagaactatggctccccattgtactaataccatacctcactgtttgaaatgccacctttatttacttcatttctaaatgcatttgaatccttttctggttctctctttcagcgattcatctgtctgtatatttgctcgtacaattctattttaattattgtacctttataatatttttaaaatatctggtatggctagtgtctccatattgctctttctttttcacacatttcccagctgttaattttagaattttttctagttctgaagctattaatttattattttattgagactttttttttttttttctgatatggaatctcgctctgttgcccaggctggagtgtagtagcgtgatcttggctcactgcaacctccgcctcctaggttcaagcaattttgaacctgcttcagcctcccaagtagctgagattacaggcgcctgccaccatgcctccctaatttttgtatttttagtggagatggggtttcaaacatgttggccaggctgatcttgaacttctgaccttaagtgatccccccgcctcggcctcccaaagtgctggctgggattacaggcatgagccactgtgcttggccgggactacattctttttataaattaacccaaggataattgatatccatatgttaactcttgctgtccaggaacagggtgcactgtacattgacttaagtctctgtgtgtgttcttcaaatagtatttacattttttttttttttagagaggcaatacatgcttatggttattcttaggtattttatcttttagtttgtttattattctcattcatttcttaatttaaaggaataatgtgttttagctacacgcacatggaaaaagttatcattggccaggcgcggtggctcatgcctataatcccagcactttgggaggccgaggcaggcggatcatgaggttatgagatcgagaccattctggctaacacggtaaaaccccatctctactaaaaatacaaaaaattagctgggcatggtggcatgtgcctatagtcccagctactcaggaggctgaggcaggagaatggcttgaacctgggaggcagaggttgcagtgagccgagattgtcccactgcactccagcctgggtgacagagtgagactccatctcaaaaaaaaaaaaaaaaaaaagttaccattttgaaactgaactgtatttgattcatttttggtgaatcctggttttcaaaacatgaagtcattggtgagacagactttcatttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgccaccacgcccggctaattttttttgtatttttagtagagacggggtttcactgtgttagccaggatggtctcgatctcctgacctcgtgatccgcccgcctcggcctcccaaagtgctgggattacaagcgtgagccaccgcgcccggccgacagactttcatttttaattgttagtctgttttctgctactgaccgcctttttgtcactttacatatcttctctgagccttagtttcctcatctgtaaattgaagaatctaaaacagatatctaaagcctgtcttcccgctctgcccacattgattctgatgtgattaacttcctagaggccttatatctgctcagggaagccctcttgatgccaggacctatgtgactcccagtggttgaggaccatctgagctctggatttctagtcccttgtggccaggctggtgggccaccatcaaggtcatgtcaggaagctcactgtccaccttctagggctaatttgtttggttgggtagttaaaggtttagggtcctggtttggaattgcttgaagtgccctagtatctcctcgggagttcgcctttccttttcattccctcctctggacccttagctctcagacctactatcctcaggctgtccacatgtctcccagtgcaaccctcattgtcaactccctcctttccctctctgccttctggccctctccccctgtcccctcaatactcagggaaggaagtggagccttgggttgaaagaactggtttagcaacgagtcaggttatgttcttatccacctttgcctttcaatagctatgtgatctttggtaaggtttagagagaataaatgcaaagtactaacccatgattactccagcaggggtcttagtgaattggtttgctcattagtggttaatagtattaatagtagcttattacataaagctatgtgctgggctctgtaataggagcttttacatatgacccattgaatcttcacaaacagccccaggaggagggtaggaattgtgtatcccattttgcagatggggaaaataaagcccaggagaactaacctgtgcaaagtcacacagctaatgagtgtctgagccataattcaaactcagctttaagatgtcactcgtgggactgaggaactgaatttttagcttaccttgttaatttcaatgtagagccacatgtggctagtggctaccatactggacagtgcagttccagatgtgtggcagcagctcagttccacgttagtcaggagggagtgctccttcctcccctctccttctatcctcccatgcccctcccctcagcaggtgggtcttacttttggatggagaacaccttctgagtttaatttttgttgcttctttaattctaacagtgtgaagagtgccagtgctggcagcatggggtctgcatgggattactggaagaaaatgtgcccgagaaatacacctgttatgtttgccaagaccctccaggtagagatttctggagtcagggatataacagtatgtagccttttccttggcacagctggctgtgacacattctaaatgtctgcggtcttgagactcatttcttcagcatcggctagactccagctcctcctcgcctctgttgctatcctgccttgtggccagctatcctgaacgtagcaataagagcacacgtgtgaaggggcccacctagtggaaggcctggccttgagctagaacttttccttttctttaattatggtttaaaaaaaatgcatgaggccgggcgcagtggctcacgcctgtaatcccagcactttgggaggccaaggcgggtgaatcaactgagatcaggagttcgagaccagcctggccaatgtggtgaaactccatctctactaaaaatacaaaaattagctgggcatggtgacaggcgcctgtaaccccagctacttgggaggctgaggcaggagaatcacttgaacccaggtggcggaggttgcagtgagccgagatcatgccagtgcactccagccagggcaacaagagcgaaacttcgtctcaaaaaaaaaaaaaaaaaaaaaaaagcatgagatctaccctcaacaatacagtattgttgttaataactataagcacaatgtcgtacagcagatctccagaactttcatcctgcctgattgaagctgtgtagaaaaatgtagaaacttcacaagtttgagtgtcatccttgtgtaggggccatgctaatcttctctgtattgttcctgttttagtgtatgtgctgccgaagtggcaccttttccttttcttgaggactcatgaggatgggcgtgtgggctctgtctttggcttttgggggctattggagggttagaaacttgcctttgccccctgtggcaacatctgcccttcatcacatcactgccatcctgaagggagaaatgcccttgaggggaaggaggaaggcatggttgggtagagcctgttgccaccctgagcagtgacttaattccttagcaggatcagttagttccatggctataggggtcacctgtggctcttgattgctcctttctagaaggggtggattgtaaatatgcagttcattgtcttggtttccatgggatggtgacattgtctcccattaccacttgtaaggttctccctcagctctagtcccctgattcctttagagctagacagtgcttgagagcctctgcttccgttactcctttctgtccgataaggtgggcctggttctcctactcccagttttgcttatgaggaagaaattgatccttgaggatacagttgactttcctcataaagcaaattggaattagaactggtttgcagagccagatctcttgattttgttggttgtctagggagggactggccaccagttcatttaacagcatgcaggtcccctctgggcctgaaggcctctgttgtgacactgtctccttgtactagaagcatctgcctccacttgtccctttatcccaaggaaagaatagtcagaagatttgacaggtgaacaaacacaagtccagaagggacatgactggcccaagatcacgccaccagctaatgccagacaggcgatgagaaccagttgtctcatacctttgccttgtaaaacaggtagtgcagctctgaatcctgctgctctaggcactgcctgcagcagctgcctctggggttcccccatatattcctgaaggctccttagcataccttttaaaaatctttttttccctactgtgtctttctctctacttttccttctttagaagtcacacacaccatcttcatcaaatcctgtgcacttactgaacttctacgactttaatcgccaatactgtgaatagactcttccttgaactgagcacagcatgtctgccacagggtctacctttatagactgactctgcagagggctggaccaaaagtttaacagattcgttttttaaaggctacttaaaaatagttttaacagaatcaaggtgtatccccaccatgtgtattagtaaagccagaagtagctcaaagaccttaataggaatcacctgggtgtttcaaggtttttatagatattgacagtcgaacaacagtctggtagaaagcttttccctgggactttggagcaggtcatgttgataagtcacatgtgcttttgttttcagtccttcctaaggagccctgtaacaaataggatggctgaagccatccagttcctatgttgttctaatgaatggataacaggtacagagaagggaaggggcctgatcatctgttgagttaggtggtagaaggtacatttgcagggggacttgaggcatctttccattcatttgataagtccattcaagatgccttttgccaggcactggggatacaaccatgaacaagatagttcctactctttcggctcttaattgggttgggagccagaaacagaagttaaaacaagttaagtaaacaagactgtgtaaggtagtgatgaatgccgtgacgggaaaattgataagacgacttgaggcactgatgatgctctcaactttgggaagtagcagaaggccccactcctgggcaacatggcaaaaccccatcaaaaaaaaatgaaagaaagaaagaaaaattagccaggcatggtggtgcacacctgtagtcccagatactcgggaggctgaggtgggaggatcacctgagcccagggaggctgaggctgcagtgagccatgatcatgccactgcactgtagcctgggcaacagagtgagaccctgccaacaaagcaggaaaaaaataaaagcctttctgaggaggtggtaaggagccaaccctgcaaaggcttagggaatagtgctgcagacagaagggatgcgcaagtgaaggtcttgaggctggaaagagtttgatgtgtttcagaaactgaaatgaggccagtgtaaaggtatggaggggaagacaggaaggaactgggtcctgtgggcctcagtaagccagagttagagagttggggctttgggtattctcctttgagcagtaggaggcagtggaaggttttaagtaggggagagaatattatgatataaatttggagataatctaggtgcccagctcacctctggccagttccaggaaatgaggaagtacatgccttattcactaccttatccccactacctaatagagagcccagcatatggtaggtgccaagaaaatgtacactggatgaataaatgaacaaaatgagtatactaatctgttcttccagtagttggtatgataattgtgtgagagtgatgaaatggcctgggtttccttcaggccttgttttaaccctcttgttgtcactgctgtaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcagtaagtgtggcacctgcagtgctgggagcagtctgtttggcatggtctgggggctgagtaaatctgagaaattggaaagctaccaaagcaatcaaatcataaaactgagtttgagacctttactaaaaattatcagtttcaggataaacattctttaaaaaaaaaaaaactttattgagtaatatcttacatataattaggttcatccactttaagagttcattgaggccgggcatggtggctcatgcctgtaatcccagcactttgggaggccgaggtaggcggatcatgaggtaaggagttcgagaccagcctgaccaacatggtgaaaccctgtctctactgaaattacaaaaattagctaggcgtgctggtgtgcgcctgtaatctcagctacttgggaggctgaggcgggagcatcgcttgaacccgggaggcggaggttgtggtgagctgagatcgtgccattgcactccagcctgggcaataagagcgaaactccgtctcaaaaaaaaaaagagttcattgaattttgacattgtatgcagccgtgaagccaccaccagaatcaatacatggtgtgtgtattttggtttgttttttgttttggcatacagttctgagtgtttttttttttttttgagatggagtctcactctgtcacccaggctggagtgcagtggtgagatcatggctcactgcagcctccacctcctgggttcaagcgattctcccacttcagcctcccaagtagttgggactacaggcgcatgccaccatgcctggctaattttttgtgttttctgtagatatagggttttaccatgttggccaggctggtcttgaactcctgacctcaagtgatccacccacctcgggctcccaaagtgctgggattacaggcacgagccactgtacctggctgagttatttgtttttaattgctgtaagatatacataatataaaatttaccatcttaaccattttttttttttttttttttgagacagagtctcgctctgtcgcccaggctggagtgcagtggtgtgatctcggctcactgcaacttctgcctcccagattcaagtgattctcctgcctcagcctcctgagtagctgggaatacaggcgcacgccaccacacccggctaatttttgtatttttagtagagacagggtttcaccatgttggccaggctggccttaaactcctgacctcaggtgatccacccacctcggcctccgaaatttctgggattacaggtgtgagccactgcacccggccccatcttaaccatttttaagtgtacagctctgcacagttgtcattcatgttgttttacaaccagtctctaaaacccttgtgaaactgaagttctataccctttaccaacagctctccatttccctttccccaaagcccctgacaaccagtattctactttctgcctctctgaatttgacttctctagagacctcatgtaagtggagtcatatagtgtttgtctttttgtgactggcttatttcacttagcatagtgtcctcaaagttcatccgtgttatagcatatgtaagaatttcctccctttttaaggctgagtaataacttgttttatgtgtatgccacattttgtttatccctttcatgctaaatattccttttttttttttttaacaagagatggagtcttgctttatttcccaggctgaagtgcagtggctactcacaggtgcgatcatcaagcactgcagcctcaagctcctgggctcaagcaactcagctcattcttttttttttttttctgagacagagcctcgctctgtcacccaggctggagtgcagtggcgtgatcttggctcactgctacctccacctcctgggttcaagcgattctcctgccttaaactcctgagttgctaggattacaggcacatgccaccacacctggataatttttttttttttttgagaccgagtctcgctctgtcacccaggctggagtccagtggcatgatcttggcttactgcaagctctgcctcctgggttcacgccattctcctgcctcagcctcccgagtagctgggactacaggcgcctgccaccacgcccggctaatttttttgtatttttagtagatacagtgtttcaccgtgttagccaggatggtctcgatctactgaccttgcgatccacctgcctcagcctcccaaagtgctgagattacaggcatgagccactgcgcctggcctaatttttgtatttttagtagagatggggtttcaccatgttggccaggctggtctcgagctcctggcctcaactgatctgcccatctcggcctcccaaagtgctgtgataacaggcgtgggccactgtgcccggtcggtctcttggctgttataacctaccctactttaccaaatacagcaacagggccttgagtggggtaggcctcttccatggtttccatgggtggagcctggactagaatccaaatcctggctctgtcaggtacttttcgaactgtctctctatgtgatactgcatgaccttgtgagctttcttttggttttagtatagtctgtgtcagggactgcttttatttaagttgtaaacagtggcagactagtgcgatgagtgagttaagacttgataggctgctcctggataggatttcctttgtgctgatcaggcctagaggaggcctggtgtcaggcagagtggagtatcaggaccctgagatggtgagatgggaatctgcttcctcttgtgctctctggcacacagaggcctggcttcaagatctgcgtgacaaaggtggtggaggagggaacattgggtctgcgttggtttgggtaaaagctgaggtgctataacaaggaccccccacatagaggctcaaacaaaacagaagtttctttctcatataaatgaatggttcaaggctaggcagggatctaggctaggtaggagacctttctccaggattccatccgttgggttgggaactttgtttccttctgtcttacggctccagcattctcttagggttccccttatctgcatggtcttaggttccttttgtcttattgctctggcattctcttgggataccccccatttgcatggttgaagcagtttcacctgcatttcagctctaccccagtccccaggagggggaaaagagagaaagaagagggagggcaaatagtttcatggacaggcctaatggcagggcaggctgggcaggtggccacaggccctgcttatacttagaagtaggggtgggggtggggataaaaggaggagaggttggatgctggggcaattagcagttgctgtggcagaatctgttgaggtgaactgaaccaaatgacggccctggataggatgtcagagactagctatttcctcacatttcataaaacaggaaaacgtaaccccatgtaaaccaaatgaatttgtttttaatgagatggcagcaattaaatgaagtaggtggatggtggtccacgtgagtgcctgggaaacctcaggggctgctcctgattgtaaacttagctatatttctttaaaaaaaaattttttttttttaagagatggagtctttctgtgttgcccaggctggtcaagtgatctacctgccttgccctcccaaagtgctggggttataggtgtaagccactgtgtctggctcatatttcttttatttttattattttcttctcgacagtcttaatagggctgaactttttaaaaataataattgttatcctcccacctcagcctcctgagtagctgggactataggcgcctgcatttcttttcatttgagggttctgtcagatgctgttctcttttttcttacagaaatgccagtgttcctggccctggcccatattctgaagccttgccctttctttttttatgtttttgagacaagggtctcactctgtcacccaggctggagtgcagtggtatgatcgcggctcactacaacttctgcctcccgagttcaagcgattcttatgcctcagcctccccagtagctgggattgcaggcatgtaccaccgcacctggctagttttcatatttttagtagagactgggttttgccatgttgcccagggtggtctcgaactcctgggctcaagtgctttgtctgcctcggcctcctaaagtgctgggattacaggcatgagccactgtgcctagccccttgtcccttctgaatcctcatctagatcctccatctttagagaaattactttgtttgtagtagaattaaatctgtcttctagcaattcagaagagggcataggaagatcttggtacttcttacaaatggagaaaagatcctgggaaaggggaaggtggccccagtatgtctctgtattcatggatggtctctgttgtcatgggctctgggtctttattctcagaaatattgttccccagtgacctggtgaatttattttcgaagacaaacaataaaactgggagtaacttcagagcatctgtcatcataaaaaacatggcctggatggctgtgcttaccttcttcatgactgacagggcttacaaggaaatggcagggtcatgcttgcgagaagtagcaccttcagatcgcagttggaaggatgaaaattgtaggtgggaggaagcagagactttaatggtttttttaataaagagcaggtctgtactatggttcgtgtgttccatgttaacaggtagtggacctgaaagttaacaatgactcccatttcccctgagcagttttagtggtgtgtctgggtcctgggtaggctcctgggacaggctgataccctgtctggaggtatcccaaacaattgatgccaattgtttcccctcttccttagtggctagcagtggtatgggattgctggagtgggagagctgagacgggatagttgcaggcccttgggagcagaattttagttctgtaacatcgctctatgccttcatgtatatgaccacttccactttcacaggaaggtacaggaaggcatccacagcattttatgtgcacatacatggaggcacagctttcagtagatgctcacaggagtctggccctaaaaaggataagaatccctgttcttttctttaataacaaacttttttctttggaatggtgcgaataaattttcagaataatttttagaagctttatcattaatgacctatacataaaggacagttgattttatttttttaacccctgggtaatcattgcatttttgtaatcaaatgccattacatgctgggatcattgtgactgtttattaataagttaaggttatttttagtaagtcacatttgaagagcactttaccaccattaattcacttaattgttatgaaactcagtgtttgatggtgttggcaaaaagagtcaaattctgtaaaatacttgaagatatttattctgagccaaatatgaggaccttgacttgtgagacaccctcaggaagtcctgagaacatgagcccaaggtggtcaggctacatacagcttggtctcacacattttagggagacataagacatcaatacatataagaagtacattggctgggtccagaaaggcagaccaacttgaggggtgggtgggcttccaggtcataggtagattcaaagattttctgattggcaattggttgaaagagttaagttattatctaaagagtcaagttattatctaaaggccagtcgccaggcttggtggctcacgcctttgggctcccagcactttgggaggtcgaggtgggcggatcacctgaggttgggagttcgagaccagcctgaccaacatgtagaaactccatctctactaaaaatacaaaattagctgggcatggtgacgcatgcctgtaatcccagccacttgggaggctgaggagggagaatcgcttgaacctgggaggtggaggttgtggtgagccgagatcgcaccattgcactccagcctgggcaacaagagcgaaactccgtctcaaaaaaaaaaaaaagaaagaaagaaaggagtgtctgggttaaaataaggggttgtggagaccaaggttcttaccatgtagatgaagcctccaggtagcaggcttcagagagaatagattgtaaatgtttcttatcagacctaaaaaggtgccagactcttccttaattttctcctggatcaggaaaggacctggaaaggaaaggaggttctctatagaatgtagatttccccacaagagacagcttccagggctagttcaaaatatgtcaaagaaatatattttggggtaaaatactttgatttctttcagtacctgctatctgttatgttggtatcttaattgctacagtctgttttgtcagtctgagggtctctattttaatgttttgttgttgttgttgttttgttttgttttgttttttgagacggagtcttgctgtcgcccaggctggagtgcagtggcgcaatcttggctcactgcaagctctgcctcctgggttcacggcattctcctgcctcagcctcccaagtagctgggacaacaggcacccgccaccacgtccagctaattttttttgtattttagtagaggcggggtttcaccgtgttagccaggatggtctcgatctcctgacctcgtgatcctcctgcctcggcctcccaaagtgctgggattacaggtgtgagccaccgcccccggcccgttttaatgttaatgctggtcagttgtgcatgaattccaaagggagaagggtataatgtggcttgtctgactcccttcccatcatggcctgaactagtgtttcagtttaatgttggaatgctcttggccaagaggaggggtccattcaggttggttgaggggcttagaattttatttttggtttacaatagcagacagatcagacagataattagcccagtttcacagaggaggaagtaggaatgatgctggttgagtgagttgtcccagagttgaaatccagtcaggtcttctgactgagagtccagtcccactcactgtgtgtgaccacagtgggagctcactaaggagtggtctcctaggagaccacggattcacattcgctcttgtttagcaaatggtagtgtgtggtcagatggcccaggtggagctgctgtccctactgggagagtatttaggaattgagaacccctgcaatggtgccagttactccaaagcccatgtcctctttgtcctctcaacagaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtatgtggctgccttgtacttgttcttcattcattgcgtgaatgcttgcaagttatcctcctagtttgaatgctctatggaagatatttattaataaaactgtatttaaatttgcttaccatagatatgttttggtttgccaaaatgggtgcaaagtcaggagagcccacttaagccaaagatccttggttccaggaagcacccacaaaatggcatagtcaagtgtggcacgtggggtggggggcgcgggtgcagagggagggagaggtgggaagtagcaaggagatatggattagcaaaactcatcttttctttaaggcagtttgcattataattgcacctagatgttaattcttagcatgagcaaacaatgagtcaaatgttttgttaggcagaattttttcaatccagttgtatgatagctttattttgacttttaactttgaagccctgtggtaaaaatggtacactttgtcaaaatattgctggtttcatcagttttcccaagagccacttttggttttttgttattcaagtcattctcttctagaacccccttgtatcacctcgttgccggtgttttcatctctaactgctcactaggctcattgtgccctgtcctcagttgtcagtgaggctttgtatgatttgagagtttctctgtctcatcatccttacttcccagactttctcctgcaggttggtgtcaccagtgttaaatacattgctgcatggtgccaaggggatcctagattacaagcccctcaagggaggggattgtatctcatgcatccttgtgcccttgactatgtctaaacggtgttgggcaaggtggtaagaacacagtcttttgagacagacgcagtttcaattctgagctcagccccttactgtgtgattctgagcgggttacttcactttcctgatcagacctgttttctcgcctgtagaatggggccagtgaagccccctcagttactgtggaacatatttgtgaaaatccctcagtaaaatccctcagttttgcacatagtaagtactaaataaatattggctagaatctatttcatttcaaatggatgaatgaaaggttgagttaccaaatcctagaaaaggtttgtggtcctgtggatcaggcaggtttcctagaggtatctggcacataaaacaaagccaggaaatactgggcctcagcaaagcaaccagggctaacagtcttttccattgatggtaagctgactgtaagctggccttgcttttatgtgccttaccctatttcatcctcatgaaccttccaaataggttttagtacccccatcctcccaccgagaaagcagaggctcagagacatgaagtagtccatccagactcgcacattcgcaggagatggagctgagacttgaaacgcgttggtgtgactcccgtgtactaacccttgtctgcactagccctgctctaatcacctctcagggctctggaagccattctgtgaggcttactttaggctaggacattggcccagtcagtaggaagcagctgtgggtcccctgagctagagtgctaccctgaggtagttggaattggtacagtgggcaagctcctgcccagttcctaagtgggaaataggaaagggaggtagggatttggagtattgaaactgcagctagtatttcaggtggctggaaatgctggctggttgaaaaatgggccaggggctatctccattcagtaatttccatgccattgcatccccaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatggtagggctccttcattggccccctgtgcattggcatgcagtcgagcacccccagacgagctgctttctgaaccccccagtctgagtttacagggaccgctgtactctttgcttctcttcttttcagcctctccccacctccattctcccctcaggatggatgagccttacttttagtatttatcaggtgcaagatctgcatgatgttgggtcctgcctcacttgtctgatcccttctgtaaagttgagtatgcagagagagggcaactggcagtcctgcttgcaggaaatatgtgatctaagccaatctttacaaacaagttctgtgagaaattaaaattttgacttgagttttaggatatctgaggatttaatctgaaaaacctcttattccaatctttgataaaatctaaaatgaagctttctcctcgtaagccagtagagatttgagaatttgcctgagtcatttgtatagccctgagtattccttccagatattggtggttacggacaggcctggaggatcaaaccggtgatgatgaacatgatcaagttcagtctctctccaggaagttgacggttttggttgttgaaatattccctaattatttgttttcatgttgaaaatggagcccagttaaaaaagaaatgttgtttgaggattctgggtacagtctggctatgattttttactgtaactgggaatataaaacatacatgaaataactcaggagaaaatgccatctgttatacaagtgatgccatgaggtgtggccgggacacatgtggctgatgtcaatgcagaggaggagagtgctaataggagggcttcctaaaactcctgagactgaagttgagctttaaggagagtgatggtgtttcctactggagaggactcagggtggatgatctggctagactggaaaaagagttgccctgttggaggacagtgagagagacagcaagacctaggctgggtgtggtggctcacacctataatcccagtactttgggaggtcaaggtgggaggattgcttgaggccagcctgggcatcacagtctctacaaaaaaataaaaaactagccaagtgtaggggtgtagtcccagctacttgggaggctgaggcgggaggactgcttgagcccaggagttggaggctgcagtgagctgtgattatgtcacggtactccagcctgtgtaacacagaccctgtctctaaaaaaataaactaaaaaaaagggattgtaactgatgccactgtctgtgaaaaacatattattagagagctgaaggaggatataatgttagacaaaaaagtgtagctcttgagagaatggcagtaggagtggctctgtagtccctgaaaagaggattagcaccatggaaacagggtgaatgttcggttgttgccacagggaccttccctgagggagaagttaaagtctactcacatcttacttccttaatcctctcttcagccaggtttggcctctctagccctgccgaatgggcagtgtggcaaggatggtaggcctgaacccccttctttggcctcacagatgacctcttgtgtgtcttgctaattcagagccacatattctgtacatttctaagactctaggccctgagagagataacaagaaagcattaaaataaatgataaagcttaaagattttatttaggtaaacagacttttgcatagtatttaagattaatcaaaatccctttttatggaatcaactctttatttaaacaccaagataaactaagctttctttctttcttttttttttgagatggagtctcgctctgttgcccgggctggagtgcagtggtgccatctcagctcactgcaagctccgcctcccgggttcacgccattctcctgcctcagcctcccgcgtagctgggactacaggtgcccgccaccaggcccggctaattttttatatttttagtagagacagggtttcactgtgttagccaggatggtctcgatctcctgacctcatgatccgcccaccttggcctcccaaagtgctgggattatagacgtgagccaccgtacccagccctaaactaagctttcataaccaagttttaaaataggaatttggatgtaacattccttttttaaaaagccggcctgcttagctgggtgtggtggtgcacacgtataatcctagctacttgggaggctgaagcagcagaatctaggaggcggaggttgcagtgagctgagatcatatcactgcactccagactgggcaacagagtgagactcagtctgaaaataaaaaatttaaaaaaatttaaaagctgacctggcgtggtggctcacacttgtaatcccagtgctttgggaggccaaggagttcaaggttacagtgagctatgatcgtgtcactgtactccagcctgggtgacagagcaagaccccatttctttaaaaaaaaaaaaaaaaaagcctagtaagctattatatgaaatatatatatatatatgccattgttttacaattggccattatttaattatttatgtagttatatgaatagtactttatttatttatttatttatttatttttgagacggagtctcggtctgttgcccaggctggagtgcagtggcacgatctcggctcaccacaacctccacctcctggcttcaagcaattctcctgcttcagcctcccgagtagctgggattataggtgcacaccgccatgcctggctaatttttgtatttttaatagagacggggtttcactatgttggccaggctggtctcgatctcctgacctcatgatctgcctgcctcgggctcccaaagtgctgggattacaggtgtgagccactgcacccagcctgaacagtactttaaaactaaaagacaaaggatatttaatgaccatgaaaagtaaaaaagtcttttggcattagagagattattttcttaaataaaaaatgttgccttggtgagcagtggtctctatacacatgatcttagtgtatttgaacagaattttttcctctgtaaccttctgtcttgctagcaaccactatgctagttggaagctgttctgcatctttaaaagagacacttgggatggtgcagcacatggtatggagagggtggcctgctggatgctggggtccagaggagatgctgttgacttcccacagtcctggctttgttcttcagcctaacagacctagacagacagcttccatctcaggaactccacacactcctgttaaccaagctcaggcactactgagtggcttagactcttccagtctgagcgttggtgcgctttcacactgtgcatgcctcctgggccaccgtagtatcgggatgtctttggtgagcctggaactagatccaaggtagttagggtgaccttaagaggggcctctcagcaactgtaggatcatcttgcaaaagattgactgactctctttgctgttggagtgacccatccagtcctgactgccttttgtccatttatttatttttattttattttatttttttaagacggagtcttgctctttctcgcccaggctggagtacagtggcatgatctcggcttactgaagcctctgcctcccaggtttaagcgactcttccttcctcagcctcccaagtagcaggcagatgcctgccaccacacctggctgattttgtatttttaatagagatggggtttcaccatgttggccaggcttgtcttgaatttctgacctcaggtgatccacctcccttgacctcccaaggtgttgggattacaggcgtgcacgtccggcctctccatttattcttctgcctgtttgctgaacagtcccctgtctccttctagttttttttaaagacttactggtgttttgaaactggtcactatccagttttcttgctcagcaggccactagttcctctcacatgactgatcttttactaatggttttcaagcttaagtctgaggaggtggtcttatttttcttatttccaagtccttgtacttgctggaattaggaagagagagggttcctccttcttggaacccccaaataccaacaagaaatatgatggaggaggataaactacatagggcccagagcaatgggtagggcgctttgctggaccacacattccttctctcgctgtgtttgttgcaggcttgccacatttcagacacaggtgagtgttagggatatagtggcaagcaaggcagactcagcctttgccctcgtggaacttgatctagtgggagagacatatattaaacaaatcatcccattacctgtaatgacaaaccatagtaaatgctcaaaggagaacatgtgatatcatagcacctgtaacacaaggaccagattcagggtatagggttggggaaggcttccctaaagaatagctcacaagaaacagaggatttagaaaggtggagaggaaggtagggctgcatctgaggacaggagaggattgcgcagtaggttgcaggctgcttgatgaagaggtactgggtgggcctttcttttgctgcactccagggtccagaaggtgctcagtacaggttggtgcatggactagaaaggctacaggcaggctgggatagcacaggggctacctgcagggggtggttcttgtcaaaggtgcagggttcccagatggtctctccccaaatgccagagctttagggggtagcttagggaagaacaaacatctttctgtagagaaatacttgttctcacaagcaagacagctttctagatattgaaccaatgatgataatgttaattaatacctgaaatcttacattaaatatttaaaggggtcctgcatggtggttcatgcctgtaatcctagcactttcaaagtggccaaggcaggtggatcacctgaggtcaggagttcgaggccagcctggccaacatgatgaaaccccatctctactaaaaataacaaaaattagccaggcgtggtggtgtgtgcctgtaataccatctcctcaggaggctgaggcaggagaatcgcctgtacccgggaggcggaggttgcagtgagtcgagatcattgccattgtactccagcccaggcaacaagagcgaaactctgtctcaaaagaaaaaaaaaggccaggcccagtggctcatgcctgtaatcctagcagtttgggaggccgaggtgggtggatcacctgaggtcaggagtttgagaccaaaatacaaaaattcgccgggcgtggtggcacatgcctgtaatcccagctactttggaggctgaggcaggagaatcgcttgaacctaggaggcagagattacagtgagctgagatggcgccactgcactccagcctgggcgacacagtgagactccatctcaaaaaaataaataaataagtaaataaataaagggagaaaataataacagagtattctgtgccactgatgattgcgtatcaatcaggaattaatatgaagcaaatcagagtttatgatatacaaatagaccttttcaagaccctatagattttcatttttcttgacaggatgctaaaacaccaggctctctgattttcaacatgggaaagctttttattttttattttattttattttattttattttatttattttattttattttattttattattttatttattttattttttgagatggagtctcgctttgtcgccaggctggagtgcagtggcacgatctcggctcactgcgacctccgcctcccgggttcaagcaattctcctgcctcagcttcctgagtagctgggactacagacgggcaccaccatgcctggctaatttttgtatttttagtggagatggggtttcaccatgttggccaggatggtcttgatctcttgaccttgtgatctgcccgcctcgacctcccaaagtgctgggattataggcatgtgccaccgcgcccggctgggaaagctttttaaagagtgagtggtaacactcagaaaggtgcttccttccaagacttctagactctggtaacagtagcctctggcaatgtgtggctgtttaaccaaaactgaataaaatttaaaattcagttcctcagttgcattagccatgtttccagcgctcaatagctgcataaggctagtggctactgtattggatgacacagacttggaccattgatcatcgcagaaagttcttttggactgtgctgctctaaagcatttgtgttttgtcctgggagtaccactttgtagagcaggtgttgacacagtgctggctgaaatggcccttcctcccttgccccatggaggctgaaatggcccttcctcccttgccccatgtctgatggaataaggtgctgaaatgcttgctgatgttcttgcaaatcaagtgttgggagttcactaggtctcatctctctcttctgccgacagtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgtattgttgagttacagtcatgcatcatataacgtttctgtcaaccatggaccccatatacagggtggtcccataagattataatggagctgaaaaattcccatcacctagtgatgtcctgatggtcctactgcataggcctaggctaatgcgtggatttgtcttagtgtttaacaaaaatctaaaaagtaaaatatatataaaaaatttaaactagaaaaaaactcatagaataaggatataaagaaaatatatttgtatagttgtaccatgtgtgtaaacacaaagtgttattacagaagtcaaagttaaaatttaaaagcttacaaagtataaaagttggtcaggcaaggtgcctcagatctgtaatcctagcacttagggaggctgaggatggagaccctgtctctaaataaaaggctgggtgccgtcgctcacgcttgtaaccccagcactttgggaggccaaggcggccagatcacctggggtcaggagttcaagaccagcctggcaaacatggcaaaaccccatctctactaagaatacaaaaattagcatggtggcgcatgcctgtagtcccagctacttgggaggctgaggcaggagaattgcttgaacccaggaggaggaggttgcagtgagtcgagatcgtaccactgcactctagcctgggcaacagagtgaaactgtctcaacaaaacaaaaaacaaaaacaaaaagttatggtgaactaaggctaatttattattgtagaaagaaaattaaaaaaaataagtttagtagttcgtgaccagcctgggcaacatggtgaaaccccatctctacaaaaattagccaggcatggtggcatgcacctgtattcctagctacttgggaggctgaggcaggaggatcacctaggcctgggagccagaagttgcagtgaacctagattgtgccactgtactccagcctgggcaacaaagtgagatcctctctcaaacaaaaaaaaattagtctatgtgttcagtgtttatataaattctggagtagcgtacagtaacgtcctacatcttcacattcactcaccacttacccagccagaacaatgtccagtcccgcaaactcttattttttacttttatatatatatatatatatgtgtgtgtgtgtgtatatgtatatatgcatatatatatgtgtatgtgtatatatgcatgtgtgtatatatacatatataaatatatataaatgtttttttttttttttgagatggagcctcaccgtgttgcctaggctggtgtgcaatggcgcgatctcagctcactgcaaccttcgcctcccaggttcaaacaattctcctccctcagcctcctgagtagctaggattacagttgcccgcaaccaagcccagataatttttgtattttgagtagagatggggtttcaccatgatggtcaggctagtctcaaactcctgacttcgtgatccgctcacctcggcctcccaaagtgctgggattacaggtgtgagccaccgcacccggcctattctatatttttacttaaccatttctatgtatagatacacaaatacttaccattgttactgcctatagtattcagtacagtaacatgctgtacaggcttgtagcctacgagcagtaggctctatcacaaagcctaggtgtgtgtaggctataccatctagtttgcataagtgcactctatgaggctcacacaataaaactgcctaagggctcattttcagaacgcatccccattaagagatgcatgactgtataaagttcttcaccattcttttttttttgagacggagtttcgctcttgttgcccaggctggagtgcaatggcgcgatcactgctcgctgcaacctccgcctcctggtttcaagcgattctcctgcctcagcctcccgaatagctgggattacaggcgtgcgccaccaagcccggctaattttgtatttttagtagaaagacagtttcaccatgttggtcaggctggtctcaaactcctgaccttaagtgatccgcccgccttggcttcccaaagtactgagattacagccatgtgccactacacccagataattttctatttttagtagagatgggggtttcactatgttggtcaagctggtctcgaactcctgatctcaagtgatccaccgcctctgcctcccacagtgctgggattacaggcgtgagccactgtgcttgtccttcttcacctattctaatcttctttaaacattaccttttaaagaaggctgttcttaccttctaaacaactatctttttccagggaggcaggtgcaaactctgccaagaaatcccaagaatgcaaaaatacttctcaatttgtctgtctttaatattcaaaagcaaattgcccctcaccaacttccagcccagtctcactcatgctttgtggtgtgaactgcaggctgattttgattgttgagagcagtgcaaggaagacaagtctggccttccttatattaacaaatggcactcactgcaataggacctatctgggaccaatccaagctgtccatggaccctaactagctccttcctggttgggcagaagcctctggaaacagagtaggtttaagatttcagaacaggtcctcattatttgccaaattctttcttccctttgtaaacgattatgctagtttaaacaccaaaagggagccagccggagagacattaaaatgagtagcttcagtaatgtaaataatccattacttcaactagttctgctttattcctaccacaggcctaaaatttggcaaggaagttgagcaagcctggcggcataagccagagctcacaagaactagcctatctctgtgaaggtgtgcagtaaacacttcacattaaaatggcccagtaacttggacattttgggaagcctgtacccaaagggcaggtgcaagttggtgcccatattggtatagaggtagccagttaagtgagcatttaatagagccagctattttgcgtgtaagaaacccaagtgggtccttgggagcccaggtgaaaaacttcccatgtgtggtagagggataacctaggttcagtcaacatctaaagatcccactatagccaacgaaggccttattgttacggactcccaacttcgtttcgccaccagccagaaaggcggtaggaaacaggcttggtaaaataaacccaataagaacgaatgaaagagacacaccagaccacaggcgctgccaaaactcatttttcattaacacggggtggggtcccaggctcaggcccccgggcccgatcatggccccagtccgcacagagcgcccggccctggccgcccgcagctccaccgctcagccagtgatgcgcacatccgtgcggcggcggatccgccgggcccgagccgcctcgggcaggatggcgagcagctgctcttgcaccagcatctccacgatctgctccttggtgcggatgtcaggccgcagccactggcgggacagctcccgcagctgccggaaagcctcccggggacccgccgcatcctggtagcggaactgccggaaacgctggcggaacgtctcgggaccgagtctagagccggcggggcctggtgtggagcgcgcttcagcttcggcctgaggcgctacgctcacgggtgcgggcccgagaggcagctccagggccgcggaggccgcagctcggggcgtagggatggcttcagggaccgcggcgttgggactggaaggctcaggggcaggcggtgaggcctctggcagcgaggagcccacacagttacgctcaggggctgagctcgaaccggctccttccagtttctccggtggcaccgccgcgggactcccagtggccgccaagatcggctccgtagccgccataactccagctccgggcgtcactctttgtccggtagctgtgtgctcagcactgcgtctgcgcgggggtggggtgagcagggagacgtttccggttaaagggcagagctcgcgtcacccttgagggagtcggactcgggaccggccgagagtgtgcggagcttacctgcaccagcgaagcgcctgcggcagccggaagcgaaagtctctggcttctctgcgtccaggtcggcgcgcgagcacccggaagccgcttgcgggctcccggaagcggcgccctctagcgttctcgagtcgcatgaggcggctgctgccctcgcggtgcgggagggcgagctgcgcgtggcctgggctccttccgaatggtggcgcctctgagcgccagttcgaggaggagtcggaggaggagcctgaatgtttggagatagacttcaagtcccggaccttatccgtgcgccgcttcggtttgcaggtgacctttgcgtgcgggcgccccttctgattgaccctgatgagctgtagctctgatggcccctccttcgggaatgattagggtgacggctggccggggctcgttcgagtggcgcccggccggtggtgacccgaacaggagagcgggacggcgaccattctctcgggaggggcccatctggagaaagtcctctcgcttggtcaaactaggagggcgatagcaccggccttactgcgacgatgacaaagtacaacacaccgtctggcgcgaaggagatgctcgagaaccctttgctgttgttatttttcgcgtgtcctccgaaaccaagggaaatgcggctctgtgggttctgttaacgtcagcatttaataagtgaactctaaatgcattgccccttatggtggccgctggcctcctgagttgactcagctcttgcaacgtagctagttgataaccctcgaaatatagcgaattgagatgtgctatattgtaaaatacgggacttagtacgaaaaaactgatgtaaaaattatctcaatactttttaatactgattacatgttggaatataatgttttgcatatattgggtcaaataaaaatgttattaatttcacctgtgtttttactttttaaatgcagcttctaaaaacatttaaattgcatgtgcagtttacattatatttctgttgagcagccttgggttagagtgttggagtgaggctaccttggtggaatcccctttgacgatacccagctcagagttgttaggaggattaaataaattaagccgttggagagaaagggcttttaagaagtttgctcttgtttttattaggtaaactgcttgctatctctgagctactgttttcttatcagtaaaatgtggatgtaatagaacttacctctcagaggtaattgagaattcagtgagatgatgtaggtaaaagcacgtggccctgacagccctcggccaggtggttttctgtttggtagctgactcacaaatagttttgtttttgtttttgtttttgttttgagactgagtcctccgcctaccgggttcaagcgattctcctccctccgcctcccgagtagctgggattacaggcgcccaccaccacacccggctaatattttatatttttggtacagatggagtttcaccgtgttggccagactggtctcgaactcttgacctcaggtgatccactctcctcagcctcccaaagtgctggcattacaggcgtgagccaccgtgccgggccacaaataggttttatatcctcattttacagaaggggaaactgaggccctcaaaggacaggggcctcatatgaaaggttttctatgaccttgcagtccttttgagcccgtgcaggatggaggagcaggtttaacaaccattaacatgccattagccctgatataaaacttacccctaccataggatgtttcctttggatgggtagaagtggaccctcatgaaatcatttccatagcctgaaaaccttgaaagtcgttgcagtgggcctttaatgttttttagttgctgacatgtaaaaattgggagatttcacatgcaaatctggatttctaatttttcttgaaaaaacggaagagctggccacactggacccaaattcctgctggtcaacaatcagctgacactgagtagagacgacttcctttagacaagatactctgtcccatttggtctcaatctcaaccattccctatggttctctgaaatagaatgttgtttgcatttactgttgctctcaggttgttgctttatttagagttgatatttttctctcttttctttttagaggtgagaaagcagggtcttagtgtttgttatgcctactggcttcaaaccttgacttctgtctggcccctcagtagttgggtttgctgcccagagtgaccaacagtgctattccctgtgtggtaacaggtactcagtttctaggcctaagggagcacactaacccttctgtggaggcaagaggtgatagaagtcttcactggggaggagacttcaagctgagactcaagaacaaaatgggtggggctcagggacattccaggtagaaggtactgcctgtacaaaggcacatagtgagtaggagcaaaactgtggaaactgcaggctatatgggaaagtggttgggatctggagaaggggtgagagatgaggttggaacactggtgggggttaaatcataaatgtcctagaattccatgtttaaaatttagttattatcttcttgtgaaagggaatgaacttttgtggcacctggaatcatgagatgttatgttagatctctagtctatttcttccatccctattgaaatcgtgaattattagagataggaggagggacctgagagatctattagaatcattgaatgtcagactggaagggcccttagaaatggaatttaaaaatccagccctttgtgggccggtaagcctgctttaaagtgattcagcagtaaaaaaataatgtggagggaataaatgaaacaagattggctcagtagttggccgggcgcggtggctcatgcctgtaatcccagcactttgggaggcataggcaggcggatcacctgagctcaggagttcaagaccagcctgggcaacatgatgaaaccctgtctctactaaaaatacaaaaaattagctgggctcggtggctcatgcctgtaatctcagcactttagaaggcttgaaagattggcagtatgtacactctactttggtatatgcttgaaaatgtccatgataaaagttaaaacattcagattcccagaatctgaaaaaaaacatataatgcctcttcttcgaaaagggatgcagttatctactttcatgtaatttacatatatccttgaaccctcccagaagtcccagattaagcttaaaatatacatttatatttcattcttttgaattttgcagattgagaaaccaagatgtcagaagatgaaggattggtccaaaataagaaagctagtaagtggtttcatgaggacagaaatcttttgacttttagtccaaactcttatcttattaggcctctttatccctagattgggagttcacttgggaagggatcataactcattcatctcatatcacttagcttccaacacaaggcctgactcctaggtagcttcagtgttgattaaaggaaagaggacaaatgtggattgcagaccatccctgagaaggcagagctctcatatgagtcccagactctttcagagacctcagtgccttttgatggcacttggttgttgagggttgtggaaaagaagcttggatacttattttcttttttatcagagccatcacactggagaatacgtcttttaaaaagcttttcattggccaagcatggtggctcatgcctgtaatcccagcactttgggaggccgaggcaggcggatcacgagttcaggagtttgagaccagcctggccaatatagtgaaatcccatatctactaaaaatacaaaaaattagctgggcatggtggcaggtacctgtaatccgagctacttgggaggctgaggcagaagaatcacttgaacccgggaggcagaggttgcagtgagctgagatcgtgccactgcactccagcctgggtgacagtgtgagacttcatctcaaaaaaataaataagttttttatttggaaataattatagattcatagaaggttgcaaaaatagttcagagaggtttcatgtacccttcagtcagttttccctaatggtaacatcttgcataactatagtacaatatcaaaaccaggaaattgacattggtacaatccacagactttattcacattttcccagttttacatacatgcatttgtgtgtgtgtgtgtgtgtgtaggtctatgcaattttatcgtgtgtggattaatgcaactactaccacaatatctagaactgtctgatcaccacagagatccctcgtgctatctctttataattgcatccattcatcttcccttcccctatccctaaccacaggcaaccactaatctattctccatgtctataactgtgttatttaaaaaatgttacatacctggaatcatatagtgtataatcatttgggcttggctctttccacttggcacaattccctggagattcacccaagtggttgcttgtatcaatagtttgtcctttttattgctgagtagtaatctatggtatagatgtaccatggtatatttaaccatccattgaaggacatttgggttgtctccacctttgagctgttacaaatagaactgctatgagttattttatgacatggctttgggtaatcacttatctttctgagcctggaaatagtaactaccacacaggatggttctgaatagtcgaggaggagaaatatatataagggaactggtgcagggtttggcacagaatatatacttcgtcatttttttaaaaccgatggttatgaagagataatacttccttgaatatgtaagttctagtatgtagtatttttaaaagtcacaggcattgatattattattagtgtattagtctgttctcatgctgctaataaagacatacccaagactgggtaatttataaaggaaagacgtttaatgaactcacagctccacgtggctagggaggcctcacaatcgtggtggaagacaaggaggagcaagtcacatcttacatggatggcagcaggcagacagaatgagaaagtgaaaggggtttccccttataaaaccatcagatctcgtgagacttattcactaccatgagaacagtatgggggaactacccccatgattgaattatcttccactgagtccttcccacaacacgtgggaattatgagagctacaattcaagatgagatttgggtgcggatacagccaaaccatatcattattgaacatctgtgtatgtgtgatactttatttacagatgagaaattaaggtctagagagattaattaacttgcccaggttcagccaatccatggcaagattgggattcaaacccacgtttaacatagacagtaggaaccatggaaggacttaaagcaggggaaggatgtgatcagatttgtgttttaggagactcagtctggatgcactgtaaagaatattgctttattgctgaacacttagattatttctgatttttcattaaaataatgtgataatcatatattgcttaaagcttgttctgattttgaattataagcatctattactatcaaatctatttggtctctgagtttgaaaaggaagcattctgatagcaagagcttggatggtaagggataccagtacttccttaagctgtaatcccaaaagaggactgactgaaatattttgctacatattgccacctttctttctatagacatgtgtttgattcatagaaccttaggacaacccctttacttcacagatgggcaaactaaagttcagaaagtagaagtactagccagggtagaatccagggcccagcaatgaatgagaattttagttgctctacatcctcatcagcacttagtatttcatttgacagagtctgtcatccaagctcagtgtcattagttattcagaaaattcagtgcagtgttgcagtcctagatcactgcagcgtcaaactcctgggttcaaactattctgcctcagctttgtgagtagctgggaccacaggcgcgtaccgccatgccccactaattgtttttttgtttgtttgtttgttttatagagacagggtctcgctatgttgcccaggctggcctcaaactgctgggcccaaacaatcctcctgccttagccacccaaagtgctgggattacaggcgtgagccaccgtgcctgcccctacctctcactttctctgtctctatactgccatactcctcttctcttcccttctcttcccttctcttcccttctcttcccttctcttcccttctcttcccttctcttcccttctcttcccttctcttccattctcttcccttctcttcccttctcttcccttcccttcccttcccttctcttcccttctcttcccctctcttcccttctcttcctttcctctcctctcctctcctctcccctcccctcccctttttctttcatcttgctctgtcgccacccccctcctcccgctttttctttcctctcgctctgtcacccagctggagtgtggtggcatgatcttggctcactgcaacctctgcctcccaggttcaagctattctcttgcctcagcctctcgagtagctgggattacagacgcctgccaccacacccggttaattttttgtatttttagtagagacagattttcaccatgttagccaggcttgtctccaacctctgacctcaggtgacccacctgcctcagcctcccaaagtgctgggatgacaggcgtgagccaccacgcccggcctcttggctctttttaaatcattcattcccaactccttcatttgctttttgcagtcctatcttctgttctcagcaaggctagctttctttttgatgtttctggaatgaccttctcttctgagatggttatttttaaaatcccttctttcctgagctctgccagtgtcgtctcctctggctgtctcagtgtcttttctttgaactattacatctttgctttgatctcttgttttaaaattcattaagccctttgacttctttgttgttcatgattatcatctgtttcatgttagcttttttatttttctttttttggtgattgtctttcatctgccatttgtttttcctgttccctgcctccctctcctgcttttttcagtaatatatttgtataagtcttgtgttatttcttttttactataactcccctttagatgaagtgagttcttctggacaagctgcttgtgggattgtgtgtggagaaaggactagagtagaattccaggctggcaggaattctcttggcttcatagtgaagcttcttctgacagggttttttgtgagtatgtgaattggtttagccctctcctcttccgatcagttggagcttggcagctgtagggctataaaaatggaacatctgtgtgtttccctggtcaccccactcccctacttctccttggtcccagtgggaccagagaggctcccagagccagcctgtccatcaccatcccaatgttctactgaaggtgttgtgagttgtgccctcaaggtgtagcccgcttctttggagaagtacgagttttgccagctctccctaaggcctgcagccatagcgttctctattggcattaaccttctggatcttctcagcacccctcattgccgcacaggctgatgtgatagcttgctactctcagcaccgtcaccctctggccactggagtgcttaacccagaaaggctgggaagttaatgcctccaggagcagctctcaagtggacaattctgaggcatgctccctgcagtctttttttttttttttttttgagacagagtcttgctctgtcgcccaggctggagtgcagtggcacgatctcggctcactgcaagctccatctcctgggttcacgccattctcctgcctcagcctcccgagtagctgggactacaggcgcccaccaccacgcccagctaattttttttgtatttttgatagagatggggtttcaccgtgttatccagggtggtctcaatctcctgaccttgtgatccgcctgtcttggactcccaaagtgctgggattacaggcgtgagccaccgcgcccggccccctgcagtcttactaaggtccccaggacattggagccccactgggccataggggtgacatgttcatgcacctctgtcaaaaaacaaaaatttatagaagatcctgtgattattctccttagctatgttaacataatgaattatgtttatataattaaccatctttgcactcccagaatgatatgttatttttacaggtactgctgaattctatttgcttatattttaagattttaagaacaatatttataaatgagatgaatctgtagctttctttttttgtgcaacctctattaggttttagtgtcagtgttctcagttcattacaataatttggtagttttccttctttttaggctctggaacggttgaagaaacattgaggttgtttggagttgcctgtgaaacctttaggaccagctgcttttttctttttaggtggtggtagtggtgagagacctcttttacagcttctctacttctatgacaattaatctatttaggctgggcgtggtggctcacatctctaatcccagcactttaagaggctgaagtgggaggactgcttgagcccaggagttcaagaccagcctgggcaacgtagtgagaccagatctctacaaattaaaaaattagtcagtcatggtggtgcacacctgtggtcccaactacttggaggctgaggtgagaggatcacctgagtctgggaaggtagaggctgcagtgagctgtgatcatgccactgcactctggcctagggcatagagtgagaccttgtctccaaattaaaaaaaaaaaaaaggaaataaaatcagaaaattagtctacttaaatggtttcggccggtcacggtggcggatcacttgaggtcaggagttcgagaccagcctggccaacatggtgaaaccctgtctttactaaaaatacaaaaattagccaggcacgatggtgggtgcctgtaatcccagctactcaggaggctgacgcaggagaatcgcttgaacccaggaggcagaggttgcagtaagccagggtcgtgccactgcactccagcctgggcaaaagagagactctgtctcaaaaataaataaataaataaataaatagtttctattggggtcactttggtaaattattttttcctaaaagattattcataaaaatctagtatttaagtgttaaaagactcattcaaattcctaaaaataacctctgttgaaacatgtcagtaggctagctatgggcggtgaactgccattttgcaaccactaaatagagaatttttgacctgaaagaggccctatggatccatactgggggttgcaaacaggtaacatgcctggcagatgacttaattgtgtgaggtgaagactttggtgaattacagagccaatacctcaactaaagacaagcaagttaattttgagcaatatttaaaccaaaacactatgcaggtcaaataaaacagtctgcaagttcacttggcacatcacgtgccatagctagtttatggcctctgccagcccagcctccttcctcataaccacacctcctgagcatctcacgttttagctatgtctcatgctccctgaacagaccctgctctttcttcatatatctttttttctttttttttttgagatggagttttgctcttgttgcccaggctggagtgcagtggtgtgatctcggctcaccacaacttccgcctcctgggttcaagcgattctcctgtctcggcctccctaatagctgggattacaggcccgcgccaccatgcccggctaattttgtatttttagtagagatggggtttctccatgttggtcaggttggtctcaaactcccaaccacagagtctatctctgtcacccaggctggaatgcagtggctcaatcttggctcactgcagcctctgcctcctgggttcaagtgattcacctgcctcagcctcccgagtagctgggactacaggcgcctgccaccacgcccggctattttttttttttgtatttttagtagagatggggtttcaccatgttagccaggatggtctcgatctcctgacctcgtgatccacccacctcagcctcccaaagtgctgggattataggcgtgagccactgcacccaaccacctcttcatatatcttttttttttaagagacggagtctcactctgttgccaggctggagtgcagtgccatgatctcgactcactgcaacctctgcctcccaggttcaaacaattctcctgcctcagcctcccaagtagctgggactacaggttcccgctataaagcccagctaatttttgtatttttagtagagacagggtttcatcatgttggccaggatgatctcaatctcttgacctcgtgatctgtccaccttggtctcccaaagtgctgggattacatacgtgagccaccatgcccggcctcatatatctttcatagctttattatagcaagactttctctgaggattttacttccccaccatattgtgaactcctggtaagcagggaccacatcttattcaccttcatatgctttgtaagcatttgttgtatagcttttataatcagcaaaacaataagaatcttctctctccctctctctctttttttttttttttttgagacggagtctcattctgtcacctaggcttgagtggtgcaatcttggctcactgcaacctgcgcctcccaggctcagatgatgctcccgcctcagcctcccgagtagctgggattacaggtgcatgccaccacactgggctagtttttgtatttttagtagatactgggtttcaccatgttggacgagctggccttgagctcctgacctcaggtgatccacccgcatcagcctcccaaagtgttgggattgcaggcatgagccaccgcgcttggccgaatcttctcataaattgtttgtggaattgaatcgaactccattttatacattatgaaaatgaggccccaagtagttaagtgacttacctaagatcacataggaataggaccagtgctctttttggcattctaccctgtaatagttacagttataaaatcaggaactgtaagagaaatgaaactttcttagtttctagaactgacttaaatgtgtgactctgaatccccagcccacctccttgcagataattgaatttaggatgtcttcaggtaaattgagatccaatccagtaattttgagtggatataatttcaggcttattgattcatcttgggcccattcatagctctccaaacttcctgcttcttcttccccaaagctgatctaattcctagagaaattgtacaaccacagctggcaagaggtgaggttggcagtaaacatttttggggtctcatcaggtcgtactggcatcatctgatgccccttgtgagcctggatactttccttgtcactcttggatcctcaggcagttcagaggactgacgggacacccttcctgcctatagccatctcctaccatctctcttgctttctccaggcccagttgtttctttcagaagccccctacacttttgaaggggatcctcttatatttccttccttaagactaggtttgcagtgggggaggcaaaaactccatacctcatctctctgtctctctttctaaaactttctcttctttctctctctgaattctttacatcttttctcatggtatgggggaaaaaccagttttgtcccttctcacctctgtgtgtgattactgtcccaccccaagagtggcctttgtctttcttctcagctgtccagccatctttgctgaactcagtgtccttctgtctacctatcagttggaggagagttaacagatataccccacgggataggaatggcagagcaggtgatgcttgaaatcacagttttctactgaggatcctggtgcaagagcaaattgagatactcaattgtcatctttaatagaaaaaagcactttagagcctatatttttctatatctttagaaggactccagagatttgagttctagtcaccaagttccattcaatatttgacacttgatttgggtgaggtcttctgttttgctgagttttttttttattgtcctgatttaaccagacttatgggacagtactatgcacccacgttccagggcctccaagttctaagtctcagagtggtccctgggctaaggtgctggatgaacctactcccagcctagaagcctcccgctgtaacaaagtacacccatttttctatgagatagagaatgagttatctttttaaatcatctttttcttctttctcttttgtgtttttcttctgttccccacttcctacttagctgattagaaatgcagttataaccttttgctttcccttcaccagacactcctagagcaagtgtatctgtgtgcttacttaaaagctccagagtagaaacctctcccaccagattgccttgagagacaatagtcaatttacaaccaaaagtatgcctgccaggaaactctgccccacctggagagtatctcgagacaaggccactttacaacctagttctgcccaagatggtggcagctcgaccaggcggtagataaggcaccaaagtgagtcatggagactcccacctgctcattccctcctctgcatgccatttatgccaattccccctcccgcttttttttttttttttttttttttttttgagacagagtcttgctctgtcgttcaggctggagtgcagtggcacaatcttggctgactgcaacctctgcctcccgggttcaagtgatcctcccacctcagcctcccgagtagctgggattataggtgcccaccacctcacccggctaatttttttgtatttttagtagggatggggtttcaccacattggccaggctggaccagaccttgcttctgttaattggatgctacaaatggagagcaagtgtacctgacatttagctacactgctttcttaaaaaaaaaaaaaaaaaaaaggccctggccaggagtggtggtttatgcctgtaatcccggcactttgggaggctgaggtgggtggatcacttgaggtcaggagcttgagaccagcctgggcaacgtggtgaaagcctgtctttactaaaaatacaaaaatcagccgggcatggtggcacacgcctgtaatcctagctacttgggcggctgaggcaggagaatcacttgaatttgggaggcagaggttgcagtgagctgagattgggccactgcactccatcctgggaacaaagtgagacagtgtctcaaaaaacaaaaaagccctatctttgcaggacaggtgagcccccaaattgagacttagcttaggagagttcttggctttgcccaaggaaggaattcaagggtgagccagtggtgttagacagcaatcttttattgaatagtgcttctccttgtggggcagggctaactcatgggcaatgaatccggagtcgatacccagtgtatgagatgttggcaactgtatttatgctcatctctaatcccttctcagccttttggctgagatcaagtgtagtatacgcattcctacccactttcaatcacatgcaaattaaggggcaggctaatgcaaattaaggggcaggttaatgcaaattaaggagtgggtttttagagttttctaggaaagaggtagcaacttcctggtcattgccaagacatttgtacactgtcatggcactggtaggagtgtcttatgttaatgagggatggggacagctagggggtcctagatcctgttttggtcagcagggttgtgccattctcctgtctcaccaggactctggcagccatttagctactttgagccccagtctcctatgtatggagttgagtaaaagtttgggtggttgtgaggattagctgagataatgcctgtgagtatcccataaatgttagactcccacattccaatccctgtgtcccctgcctccagaatctttcattgtgaccttaggagattctgagaatgatttttctcagagcagggcttccagtagctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactggtgaggaggggcaagggccctgggagggaagagcagaagactgaacagacaggtgttttgaggaaggtcgatgcaggtgtaggaggggtcttggatgaatggtggccatcctgtaccttttggagtcacagcatggcacaaaggagggacccctgccctgtagcctaccagccccccacactgggcaagccataagccacactcagagccactgagtcctgttctgtacccactcttcctgctattatgagatccagagagaacgagggaggatagagtcagggtagcaacattgagtcataggttaagcttgtgaactctggagccagactacctaggtttaaatccctatcacctattagtcatgtgaccccaggcaagttgcttggtttgctgtgcctttattttctcctctgtaaagtgagatgataatactagtacctactgcataaatttactgattaaatgatttacatatcagaatagtgctttggataatgcctgacaatagtaaattgtactcagtaagtattaattttattcataaagtacctttccccatatttccatagatatctaatttttaagaaatagaacattacaggtgtagggaaagctctttaccatcccatgcccctttatttctctttaatagtaaccactttcctgaagttggtgtcacccttcctgtttatatttttatatattatcacatgtgtatgtatccataaacaatatatagtatgtggcacactgtttaaaaatgataccataaatagcatcatagttcttttttcccactcaaaatcatttcagctttatccacattgacacacacagacttagtgctgtgttcaatcctgtgactgaaccataatgtattgatcccttcgatccctactaatgaacatttgttttcagccattcactgttacacacaatgttgccatgattaccctcatggctatccccttgtacatgtatgtttctctgaagaggacatataaagtacatacaattcttccattgtgaagtacacacatcctcaactttatataatgttgccaaattgctcttcaacatggttgtaccatgtttcccagttcccagtgataagtgcaaaatagtatcatgttattactttaatttccatttccattatttctagcaatgttaaaaatggtttcacaatttggctggggcatgaaggctcatgcctgtaatcccagcactttgggaggctgaggtggaaggatcacttgaagccagagttggaaaccagcctgggcaacaaagtgaaaccccctctttacaaacaatgtaaatataaatacaaatgaataaaaacaatattttcacaatttataggtaatttgaactttccctttgaattacctttgctcattttgctattgggttatttgtatttttcttttgatttgtaggattacaaaaaataaattttggatcgtaatcctttgttgattatatgcatagtaagtatatttttccagtctgtagttcgttgtctcactttgtttatgatacactttaaaaagaacattctcttttttcctttgtttgtttttatttatttttttgagacagagtctcactctgttgcccaggctggagtgcagtggcgcaatttcagctcactgcaacctccacctcccaggttcaagtgctcctggtgcctcagcctcctgagtagctgggattacaggcgcccaccaccacgcccggctaatttttgttttttttagtgcagatgggatttcaccatgttggccagactagtctcaaactcctggtctcaagtgatcagcccaccttggcctcccaaagtgctaggattgcaggcatgagccattgtgccagagctgtttgtttgtttgtttgtttcattttgttgttgttgttacagggtcttgctctgttacccaggttggagtgcagtggcacgatcatagctcattgcaaccttgaactcctgggctcaagcaatccttctgcctcggcctcccgagtagctgggactacaggcgagtgccactgtgcctagctaacgatgtacttttcaatagaagttagtaaacagagacttttatttagtttttgcatttttttctttttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtgttagccgggatggtctcgatctcctgacctcgtgatccgcccgcctcggcctcccaaagtgctgggtttacaggcatgagccaccgggcccagcctggctttatgtatttgtatatgtgtttgctgaattgtttgaaagtaagctgcatactttatgacatatctttcttaaaaataatgacattacccacataaccaaataccactatcatactaagaaaatcggcactgatttcctaatattatctaatgtacagtcatattcaatttccttatttgtccctagagtgcctttgctctgtcacccaggctgtagtgcagaggcgcgatctcagctcactgcaacctctgcctcccaggttcaagtgattctcctgcctcagcctcccgagtagctgggactacaggcaagcaccaccatgccaggctaatttttgtatttttaggagagaaggagtttcactgtgttggtcaggctggtctcaaactcctgacctcaggtgattcacccgccttggcctcccaaagtgctgggattacaggcgtgagccaccgcacctggcctagggtgccttttatagcttgttatcatgaaccaggatccaatcaagaagcataccattggtatgtctcttgaatctttattaatctagagcagcccccatgccttgtttttttcatcatgaaattgactttttgaagaaactaggttcattgatttatagattcttctacatcctggatttttccctatcttctgtattcacttgttctcagtctaattccaaattcctggggaaaaggtagggtggcccatcttggattaggtgttatataagttttctatggctgccataacaaattaccacaatttgatggcttaaaacaaagcaaatttattatattacagtactgtaggcaagaagtctgacatggatgttcttgttctaaaatcaaggtgtgagcattcctttctcaaggctcacggccttttctgcttctaaaggccacccacattccttggcttgtgggcccttccttcatcttgacagccagcagtgttgcattcctcttaccattattccctcagatctatctgattctaaaatccaggctctgtacatcatacctatactgcctgcaattagtcgtgccacttattttgtggatggaattgaaggatttgacatttagctggtttgctggtgcataacaactagcttctggggagagatgtcctgactagtagctgccaatttctatggcataagtactcctaccatggccagttttaagttaccaacttaatttcagcaggcttgcaaaattcctgaaaatgtaaccatcactccagcacactacagcacactactgcatttaatcctggtaaatttcaccttgttcagcaccatccagcctgctgttgactgttgagaacagatggtttctattgatcttgtttgctttgtttccatagggactgtaccagctcgccatggatatcatcataatgatccgagtgtgtaaaatgttccgccaaggcctcaggggattccgggaatatcaaatcattgagactgctcactggaagcaccctatcttctccttctgggatgtaagcagttgggctcagcaggattatgagggctcaaagaagcccaataaattgcatcccacttcctggcctaagctcagaactgagaaagaagacaaaaggaaaagcagatgagagacccaatggtcacttttattaatggccatacttctgttggagagggtgacttacatcatcaaccaagaggtttacctaatactgaaccccagatttagacagccttacatgcctagccacaggcaacgctggaccaaggcaggctccactgcaacagcaggcctgctgccaaaactcatggcagggaaaggtggagcaaaatatgggctgagagggaaggagacaatcatgcctagtttttctctttccaaattcatcaaagagtttaagtcactcctcaatgtaaaaggagagaggccagtagtgttctactaatacacctccctccatgtggaaagaaaccttgggagtagagaggtggtctccatttcaatggtgatcaaaagagccagaagcaatccaggaatcacaataaccagggttttctaaatgcccacacgctctctctattcgcgtctctactttctttcctacacccctacttcggtgcaggggcattttcagggctttgttcactgcggtgaccatgtttcttttatttttttgagacggagtcttgctctgttgcccaggctggagtgcagtggcgcgtcttggctcactgcaagctccacctcccgggttcacaccattctcctgcctcagcctccctagtagctgggactacaggcacccgccaccacacccagctaattttttgtatttttagtagagacggggtttcaccttgttagccaggatggtcttgatctcttgacctcgtgatccacctgcctcggcctcccaaagtgctgggattacaggcgtgagccaccgtgcctggcctggtgaccaggtttctagatttcctagaaggtcccaatttaaaatattttatcccagtggtagatcatgtgcccttctttagctcagaaaagttggtcacccttctgctaacttgttctagttccccagaggtatcttcattgctactgggtgtgttgctcagggcttcaaagtttccccagcaatcacctggacaaatcctgcccatttttctgttgtttcaggaatgactagagccagtccccactcctctgcatctagtgattcactccaagaaatttccctaaagggcttctgacagatagtggccaaagaaagggggatacggggctggtgatgggggaaggaaaggcagccttaaactggtttctgaggggccagcaggtaatataactagtgtgtatgtagctgagtttaagatacagcaggccagctggagaggaaagatacacctcatctaaagacattcagatacaaatattatattttaagaccctgtgctggccaaaccaaacaaggctgcagccctgtggttgggctgagatgaaaaacgaatggagtagaagaactgtaaccaaaagactcaggttagctctcaggaaggacctcctgactctcagggtggcatgtaatggtgatgcaatgggccctggagatcagagggctttggttaccagaagacgtggcctgatgcatggggcagttggaagctaagatgcagagtcacttgttgtcaggggaatgtgaggctaagcctaaccacattggccagccagagtggcttgagcagagcagaagcctctcaagggcagcctataagggtcatagggttgtcaggcggagcactgggcggctggagtgcaggatcaggtggggagccctagactgcttcagtagatgtgtgaatctggatgtttctgagcactgcctctttccttcagtagtctccctgagaagcaccacatggctatgcaaaggataaacacgttgtgggggcgagacgggtctgagtctaaggaacaaatgacatgtggcttgaggccacactccagacacggaattgggtttgctgaaagccttgagttggggtctcagctagaccactgacttgctgtgtgatccttgggcaagttccttcaccatctcagtcctacatggagcttaataaaacctgctttgtcctgatgactaaatggagtaaggcagggaggatacactgtgcttggctcattaaagacatttaacaaaggttggcttcatttgttcctttcttttttttattttttttatttttttttattttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcctctttttttttattttttgagatggagtcttgctctgttgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccaccttggcctcccaaagtgctgggattacaggcgtgagccaccgcgcccagcctgttcctttctttttattcttccttttcttcctcctctatgcttgtttgtttgctgcttttcccccttccttttctctctcctttcctgtttcctccttatcctcctttccttctccccacccccatatttctctgccttcacaataatatgctgtaaatgctggacccaagcctagtgctgagttggggccttcgagcagaggcaggcctgaaagggccggctgctatgaggtttcccatggcttcctgcccaccatggtggtccaggtagacaggagggctctagatgcaaagttctaggggcagtcttgctgattctccctcttctccctgccctctttctttcagaaaaagatgcaaagccgagtcacatttgataccatggacttcattgcagaggaggtatgcatagctcgaaacttgctgtgggggaattttctttctgcaccctggcttggaagaaaccctggctgggtatcagcagagctggtttcagtctaggctctgccaccaactcagcttgtcaccctgggttggccacttcgtttcctcatcaataaaatagctgatctcagtgattccttccagccctggagctccaagactgtgagcatgtaggaaccagctgtcactgcacagttgagcagaaccaatgggagagagttcctgggcttggacccgtgggaaaacagcaggaaaagataaagcagaggatgtgagagtcccagagagaggaagaattcaggtggtgggaaagggctgacctgtgtgaattctggttctaccctgaattctctgagagatgctgggcacacctctcacacctgggtgtcagatacccttaaagagtcttattcaggtgcagcgcagctgttgacactcggaaggctgaggtgggaggatcacttgaggccaggagttcaagactgcagtgagctatggtcgtatcactgcattccagtctgggtgatagagcgaggccccctctctaaaaaagagtcctctcattttgatgagagaatgcttttatatccatgggagctttggactgtgtgacttgttccctgaatttcaatctcatcattgttatcttcttggcttctctccatgatatcctggatattaaatattaaaatccaatttaaaatttaaaagagtctacctatttatagggaacatctgaaattctcaccaatgcagacctgacttgatcctggcttggagtagccacgttgttgtttttttcctcagtggaaggggaaagaaaagaactttataatgggtatcagggccacctgtgcccatctcctgccccacccctttctcttcttggagcccaggtatggcttctgttgcttgcctctcctgggcacagccttatttttcgtgccccctcgtgtatgaagcatactcagttaagtcattcaagctctgtgactcttcagctcttcaggctggctagtgtgtgacactgagcactgaagcttaatcaggctctttccttcaggcaggagaaactaggggcctatctgagagccacagaactctagatatgagggcaattctgtgcaccgcagtagagggcgggaagagggcacaaagggaaaattctttgttatgggcaaggcctataggtggtcctcaaatgaatcatgcctgactctggttccaacacagggaagagtagagagccaatttatcctcccgtctcagccttctgagtagctggcattacaggtgtgcgctgctgagcccagctggaggctcattttaaaaaccagccctttggccagatgtgctagctcacgcttgtaatctcagcactttgggaggccgaggcaggaagattacctgagctcaggagttttagaccagtctgagcaacatgtgagaccctgtctctactaaaaattaaaaaataaaaataattagctaggcacggtggctcacacctgtgatcccagaattttgggaggctgaggtgcgaggattgctggagcctgggaaatcgaggtcgcagtgagctatgactgtgccactgcactgcagtctgggtgacagagtgagaccctgtccccctgcccccaacccatcccaaaaaagcaagcccagccctctgagtgatgctaatgagtatagggtttctttggggtgatgaaaagcttccaaaacagtgtggtgattgttgtacaactctgtgaatacactaaaaaacactgaattgtacactttaaatggtgatttccagggcatgtgaattatatctaagtaaaaatgacatataatatatagtacacacacatgtatagttatataacctgcccctcagcacagcatttggattctgatggacaactaagcctcagtatagtccatattgggcttctaataacgctaaacttctcacagacaacccttagtattagagaggcttagaatcatagactcaattattgcagcaactgtcagacagtggaaacaatggatacatttacaaaacattgtttagaaaaacactgagtgaagaaaagcaaattgtgcaagtgatgtctacagtcttgacatttatgtaaattttttatttttagtttttgagacagagtcttgctgtgtcatccaggctgaagtgcagtgatgcaatcacagctcactgcaacctcaacctccttgggctcaagcggtcctcccattttagtgccccccagtagctaggactgcaagtgtgtgccactacgcctggctaattttttttttttttttttgagacggagtcgagctctgtctcccaggctggtgtgtagtggagcgatctgggctcactacaagctctgcctcccgggttcacgccattctcttgcctcagcctcctgagtagctggaactaaaggcgcctgccaccacgccctgctaattttttgtatttttagtagagacggggtttcaccgtgttagccagggtagtcttgatctcctgacctcgtgatccgtccgccttggcctcccaaagtgctgggattataggcaagagccaccgtgcccggcccaatgcccagctaattcttaaattttttgtagagatgagggtcttgccatattgcccaggctggtttcgaactcctgggctcaagtgatcctcctgccttggcctcccaaagcactgggattacaggcatgagccactatgcccagcagtaaattttaaaatacaaaatagtcttatatattctgtgggtacatatatatgcatacataaaagtggtaaactcagatggtggggagcagatctggattggggtggtgtatacatataagaggattttaactatctgtgttgttctgatttctaatggaaaatatgtgttatttctaaaaattttacttacacctaagaaaaatagaggaagttattatgccagatgttaatggctaattttgggtagtgggattatggtcagtcattctttcttgatccttcatgtcctctggaggaacacagtaggggtgtggctggcctgcagtgagtgaagggaaaatggtgagaaatggtgtttgagaagcagacgggccaagtctcctatgccctatttgaagtgtattcccttttccccatcccagacattttttgagctcctaaggtaggcctagatctgtgtgtggttgtgaggaatattaggctgtgtaacatccccagcctgccattgaggagctaactaggagttatgatgagacttaactagtaagttacccactttcatgataattacattaatccattcactaaggcagagcccttgtaacctaattacctcttaaaggtctcagttttacaaatttttttgtagaaacaaggtcttgctatgttgcctaggctggtctcaaactcctggcctcaagtgatccccctgccttggcctcccaaagtgttgggattataggcatgagccactgtgcccagcgtccacttcttaatagtgtcagaatggcaattatattttgacacaagttttggaggggacgttcaccctatagcaagagcctactggggaaggggctactctttcagctaagacgacccagtggggactcactgagggtgtggcagcatctgagctgagaccagaatgatgagtcagccatgtccacgagaaaacccaggggacaaatattccaggcagaaaaaaacagcccaggcagagacctcaagacagagccgagcttagcacatgccagggacaggtagaaagttccagagtagagaacaaaggggagaggtaggagatgaggctggagagaagccattgagggtgttcacaactcacagtgtcacttcttcagcaggtgggagtggtaggtgaacgtgctggtccatgaggcctggttcactggagaagaaaagctttagctaatagtctctggaaggttcactttgcttgttagtctcctgtagcacactgagctctaggctgagacagaggcaaaggtctcccctgactgctatgtgtatgtgctgagcagactctgcaggaccactggagcccagggaagcctgtattgcctgggaaggtcaatgaacaacacaggtcggggggatgtcagcgttgatatgtgtcagatctcctaatcctgcctgagtttcttcatctgtcaaatggaataacagttcttgggctggcaggatgcagtgagatgggcgtgtaaaatgtttatcccagtgcctgacacacagtaagcactcatcacgtcagccactgtggtacagggaacgggagagtgtacaagcaggactgtggggtgttgcccgctggcccatgggtgaaattgctgggtcccctgtatcactctggtcctctctccccagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtcagtgaggggcacagcccttggccaccaggctgaggctggactgagcaaaagagcctggctgagaaggtgtggcaggtcctgcccacccctctgcataatgtcagccatgaatgaagtcttctgtccattcacttcagctcccactgctatggtcgcagcaccctttatctcgctcacttattgagactcttaattaaagggccattaaatctggagaggatctagtagaaacctcagagaggatctggtccaattccctcatttttcagatgaggaaactgaggctctgtgggggaaaatggctcctcctaggtcacccagacaaaaagaaacagcgctgaagctcttttcagttacgcccatcagagcttgggatgaattctttctgaaacagcttggctttgcttgaattaccactgaggtcagtgatgctctgattgagagttgagaaagggtagtttcccaaaggagaatcagggtgtgattggtggaaaaatatgaccagatgcttgacagcaaaagcgacagatgtctgcttttggagattcgggttctagctctgacttgattgtggcttgccgtgactttcagcaagctgtgggttccttgggtccccctttccccttcccaaaaatgttggttgagcttgatggtctctgagggtctttctggctctagctctagtcatctttacttcagtgaacagtgcctgtgctccctcatcttcaaaatctcatttcctagctgaatattcctgctatctcccagctagtcattatcacctgggccatctcctctttctttattctttttattattattattttttgagatgggtctcgtcctgtcaaccaggctggagtgcagtggtgtgatcacagctcactgaagcctctacctcctaggttcatatgagccttccacctcggcctcctttgtagctgggacaaggggtaggcatcaccattcctggctaattttactttttattttttgtagagacatagtctcactatgttgctcagggtggtcttgaactcctgagctcaagtgattcttccacctcagcctcccaaaatgctgggattacagacgtgtaccaccgtgcctggcttgcctctttcctacattgataaagattccaggctgatactggtttgtagctcatgaagcccacagccacaatggaggctgggcagtactgactccagcctggtgtggtcctctgtctgtcctctgatcccttccctcaggagtttgccacagaatcacaaggccagtgagtactctctaagaggtcagaagaggagatgctgctgggggctgggtcagggaaggcttcctggaggaagtaggatctgagttcctgaaaggatctgaatagtggagaagacagggaaggccattgcaggcaggggagcaacatggacaaactgatggaacaaagtgggtatcatctgccctgagcagggtgttggttcccctgctgctggtcaagccagcgagtcaggaaggagcagaaggtggcagtgtggagggggaggaggaagaggaggaactgctgagggcagggccatgagctcagagctggggacaatggccctgctatcggggcacttccacaatggctgctcatcagtcctggcagagactaaagggcagacttttttttacccattgtctcctgggtaaaatccaaacttagctgagctttggaggccctttatggtgggaccagtcgaatttctctcccaccactcccctgacttgccttctcccattttcctttcccgtgaagtgcacattacctatgaagtacacgttatcccttgaatgtgccgtgctttgggccacctctgcacctttggtcatggtggtccctgtgcctgggaccctcttccatctctttgtccacctggatgactcacttcaagcaccatgctagagccttgtctgaccttcctaagcttggataaaggccccttctctgtgctcctcaagtagcctgcactgacatctcttaaagcatttttaaaccttatttacatcctgtatgtgaccataattttgaaaacaaagtctgtgttgttcattgtgcccaatttttttttttttgagacagagtcacccaggccagagtgcagtggtatgatcatggctcaccatagccctaaactcccaggctcaggtgatcttcccacctcagccttacaggcagctgggactacaggtgtgcacccccacatttggctaatctttgcattttttgtagagatgaggtttcaccttgttgcccacccaggagttcaagaccagcctgggcaacataacaagactccgactctccaaataatagaacaattagctggatgtggcaacttcaggtctcagctcaaatatcccttccttattgatagtaatagtaagaatagctaacatgggactgggcacagtggcttactcctgtaatcccagcactttgcaaggccaaggtgggaggatccttgagcccaggagttcaagaccagcctaggcaacatagtgagaccctgtccctatctcaaactcctaggctcaaatgatcctcccaccttggcctcccaaagtgctgggattaacaggcgtgtgccaccacacctggcctcacggtacctaacagacaccactgatatttatttaacttattgaatgaatgaaggaaaagaataaatatcgaaagaattgagatttggacttgcatacgaaatacagaaacttccctctgagtttaagaactccttgttcgctctgggcctgggcacctctaccccaagggtgcccagttgggtagtgggctgctggtaattatgataagaccattatctgtgtctcattctaggcatactcatctgcattttacagacaagagaaaccaaggatcagagaggggatatccattgctcagtgtcacacagctaagagcagaaccaggatttggatcctgggctaacgctaaagccagtcctcctaatcatttagtgactctactaacccattcattgctttcagcatgtgttcactcatttattccactatgttcaatgaacattcactgtgcccaagcacacgcagcagtgacccagactggcaaagactctgctctcaggaagcttcagttcaaccgaggcaggcaacgggataggtgttagtgaaaggctccagcttgactggcagggctgggctgtcctgagggcccttctggtccaagtctgtgctcttatatcccaaagcaaagagcacaaccagtccagagctcctctcagcttggacctgcccccatgtcactacccaatcaactagcagtggtcttttcccaggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggtaagcccaggggaaggacccagtttcctggggtggagtgggtggaggtgacaggacttctgctagaacctctcagccaggcccagtcctgcctagtactctgtacaagtcagtgtcccgtgtgggccccttacctgtcaaatgctaattgagttggactaagatcagcctcttcatctgtgatgtttaagaagtatgttcctgatacagccctttagagatgaagtgactccatagtgaggcctctccagcttcctcccctctggcctgttcaggtctgttgcctctttttccataagcagcagattaagaagaaggggagtgggccccagtgggagaatgtgcaggagaatagaggaggctagggaacacacagtctggtgaggagagaattcagggggaagatggaggcacggaagatgtgtgtaaggctgaggacaggaagtggaggtggcctcacacttgcccttgccctgtccacccaacaggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggtaactctgccttcattcaacatttttttccccttgtgtgtttattagctgcctgactttgtctgtcctaggcctggtgggaaacatactggttgctgttctctctgtctgggatgctctgaagtcccacctcgtacccaccttctctctctgcagactcctactatcccttcgggtctcagctcaaatatcccttctttattgaaagtaatagtaagaatagctaacacgggactgggcacagtggctcactcctgtaatcccagcactttaggaggccaaggtgggaggatccctgaacccaggagttcaagaccagcctggacaacatagtgaaatcctgtccctacaaaataaaaaattaaaaaaaattagctgggtgtggtggcacatacctatagtttcagctacttgggaggctgaggtgggaggatcacttgggcccaggagttcgaggctgtggtgagttgtgatcgcatcactgcactccagcctgggcaacagagtgtggtcctagtagctaggactgtaggtgtgctgccacatccagctaattgttctattatttgtagagatggaatcttgttatgttgcccaggctggtcttgaactcctggtctcaagtgatcctgccactttggcctcctaaagtgctgggattacagacatgagcccccatgctcagcccaaactataaaactataattccttttttttttttttttgagagagggtcttgctctgttgcccaggctggagtgcagtggcatgatctcatctcactgcaacctccgcctcctgggttcaagcaattctcctgcctcagcctcccacatagctggaattacagtcatacaccatcactcccagctaacttttttgtatttttagtagagatggggtttcactatgttggccagggtggtgttgaactcctggcctcaagtgatctgactaccttggcctcccaaagtgctgggattacaggcgtaagccactgcgcctggcccaaactataattcttgattgcatggtaatttctttacagtttatataccccctcagacagtaagcagtatggtgacagagaccagatagatctgtctttgtcactactataatccttatgttgtcacactgccagacacatgcaggtgctcaacaaataaatattgagtaaggtgaataacaggatataaataattacaatcacatgtgagtcagaaagtaagcaccgtaactgggtatcatatttaaaagcagaactcatacatagcaaaagatttttggtttttgaatacttatgtgcatgaaaggccacgtaaggatatgcaagtgaaatctcatttaattgctcttcagttatttgcctttatgtaaaaggaataaaaatccaatgaagtatctgcactggccctgaaaatttgggctgtagggctgcacagctacagagaagtgtgatggccgaggggtctggttcctgtggctggggctgagagaggtagcttcatcccctggaaaagtggggatttagtcctaaagggaggagctgttttttttttccatactgtggaaaaataggtctggctccaatctcagctcttaggttaccagcgatgtgaccctagataggtcacgccatttctctgtgttttagcctcctgctctgtaaaatggggataaggatacccttctcccaaggtcatggtgaggatggaatggaatgatcatgggaagtgtatggcccagtgcttggtgcgtggtaggtacttcttctatggtggccctacttttcttctggtgtcttcagaccttcgtccctgacatggcactgagcgtgttcacctctggtgccctgaccttaactcagtgcgcgcattgaggcctgagtcaccttgagttaacctgattcaatgaactcagtccacctgagtcagttaagttctgagcccttaacctgttggaggtgagaaaatctgagatgattgttggcagcacttggagcagcatatgaaggcaggcaagcctgtgaacgtggtgttcaaggtcaggggaaggggcagtcacagtggggtgggttcacccacagggagcaacaggcagaaagagtggagtccagacatgtcccactctccagacccagagctgaggatttgaagccaacaggccagggggacacaagggttggatgagctgcccaaagcaaaggtagggccagaaccgctaagttgggggacagagcagctgtgagctggagtggggactagcttcatgagccacggtggggagggatggcagggctggaggaggagaagattcttggaaggaggagcagaggtgagaaaagcacagaggctggatcacccaggggcatctgagcagcagtaaagaggggagcttggctggaggggagggccttgggaaaaggaggagggagccaaggtgatagcaggtaggagaatggctacaggcaaggccaggtaattgggcaggtagcagcgaaatcttccacccaggcatcctccacaggagaagagtatgtgccctctgcagattgctaaggtctgggcaccttgtgtgatggagttgatgaattctaacaggctcttcccacaggaagatggagctgtttgcatcatggtctgatgagaagctctggcagctggtagccatggcgaagatagagaggttctcgtatgggcagctgatctcaaaagattttggagagtcacccttcatcatgtttatcagcaaggtgaaaagtctgggggttgggatgagggtgaacctctgaggagcatgcctaagatcatgtcctgtgacctgatggtcagagtttgagcccttttctgcaacctgtgcaattcacttccttctcagagtttccatgtcccagctgtaagaggcctgcctctcacagagcatggctagagacattagatatatggctattgtgttagaaagaggaccaagggattctcccgccttgagctcctaagcatgcttatttacatatagatgcatatttaaattatgcatttggctgttgaatcttagtgatgccagatcacttttaaatttatttatttatttatttatttattttgagacaagagtctcgctgttgtcagcccaggctggagtgcaatggcacaatcttggctcactgcaacctctgcctcctgggtttcagcaattcttctgcctcaccctcctgagtagctgagattacaggtgcctgccaccatgcccggctaatttttgtacttttagtagagacggggtttcaccatgttggacaggctggtgtcgatctcctgacctcaggtgatctgcctgcctcggcctcccaaagtgctgggattacaggcatgagccaccaggcccagcctatttatttttgagacagagtcttgctcactctgtgccccaaactggagtgcagtgacgagatcttggctcactgcaacctctgcctcctgggttcaagtgattctcctgcctcagcctccagagtagctaggactataggtatgtgccaccatgcctggctaatttttttttgtatttttagtagagatggggtttcgtcatactggccaggctggtttcaaactcatggcctcaagtgatctgcctgcctcagcctcccaaagtgctgggattacagatgttagccaccacacccaaccttaaattatctttaaattgtaaaagtgatatgaccacattaggaaactttctggaaaaagggaagaaatcatccataaacccatcatctcagagtagagtttcaaaatggaatttcttggtatcatgattttgttttgtaaggcagactttattcaaaggggccatagccataggtatagggaccactgcaatggagtcttgcagccagagacagagattggactcaactctcagtatcgtaatttttatggctcctgcaacaaattgcattccaaaaggagagccccaccttatctagtgtccaggatgtacatttttgttggtgccatcacagctctgccagccttgcatgtcattttttcaaaagttttctagtttaataggtcgcaattgctgccatactgaggatttgatattttttctgattactagtgagatttatcatgtttgtttatgacctacattttatcttttgcaaattgcttcacgtcctttgccaccttctctgttggttgataatgaaaagaaaatctcccatttctcaagtgcttactgtatgccaggttctatgtttcacatgcttcatctcattttagtctctatagcccggaggaggttagtattgtcattattcccattttacagaggaggaaactgaggcacagtaaggtgaagtggttatccaaggtcacacagctgatgaagtgcagaggcagggttcaacccaagtctctctgactgcaaagatattttcaagaacttggatttaggatttgggctgacctttctgtctggttcttacagattaagccaccacaggcatttgttgagtttttgccaaggtcatgacacattggtccaggctctggagggatacaaagatgaaaaagactggttttctctctttatagatctcctccaccagattccacacatagacaaagaaaagtgtcaatgccaagtaccaagtgattggtgcaaactctgcaagttacaagatttcaggagagggaactctctaaaggctggaggctttaagaagggcttcctggaggaggtgaggtgggagatgagccctgacatattgaaccattaggcaaaaggaggaagcaagattggttgtgtgctggcactggcttgtacctgcctatgagagctgattgttaaattttcaggaattttggtaaacatagtaattattacaaattagatgctataaacctacaattaaataagttatatggaaaattaggagctgggcatggtggctgatgcccatagtcttaacgactcaggagactcatgcaggaagatcatttgagcccaggagtttgaaagcagcctgggcaacatagcaagaccctatctctaagaaagaaagacagatgagagagggagagagagagagagagagagagaagaggggaggggaggggagggggaagaaaggaaggaaagaagaaaggaaggaaggagcaagcaagagagagaaggaaagaaagaaaacaagggtaatacatactgaaaactcatcatttcctactgatgttactgcatttttactagtttttctcttcaggttacgtctattgtgtctctatggtagaaatactatgcaattgtgagcatctcttccccactccacattcagtgacctcatgttggtagcttacaattagccatggttggataatttatacaatggaatcagcaaacaccctaagtcaggtcttggtttagggctttgctgattgtcttaggaaagtgataaaagaaaatgcttataatgcagattaaatttaaaagtggcttgggtctatagctgctacactgcaaagagaatgaaatcgtctaacaatatttaaaagctattattgctccgggcgccgtggctcacacctgtaatcctagcactttggaaggctgagatggatggatcacttgaggtcaggagttcgagactagcctggccaacatggtgaaacctcatgtctactaaaaatataaaaattagctggacatggtggcgcatgcctaatcccagctacttggaggctgaggcaggagaattgcttgaacctaggaggtggaggttgcagtgagccaatatctcaccactgcactccagcctgggcaacagaatgagactccatctcaaaaaaataaaataaataaaaacaaataaaagctattatctggctgggtacagtggctcacgcctgtaatctcaacactttgggaggccgaggcgggtggatcacttgaggccaggggtttgagaccagcctggccaacatggtaaaaccccatctctactaaaaatacaaaaactagccaggcgtggtggtgtgcacctatagtcccagctactcaggaggctgaggcaggagaatcacttaaacctgggaggtgaaggttgcagtgagctgagatcatgccactgctctccagcctgggtgacagagtctcaaaaaaaattaatttaaaaaaaaagctattatctcattcatcatagaagttataccattgaacaaatgaagttctgatgtacatagtgctaaagctaaaaaacatttcagtttaatataatttatgtgagggtgagaaatagaacagtatatcacaagtcagatttaataacattgaatttattgggaagagaatggattgggatgcaacttcatttgtccaatcatgtttgagttgcaactataaactggccatggatacaagattcagccaaaacccacaaaagaattctgtgagagctgattggctgtatggaatttcctgtatggtatattttattatttataaattgtgtgtaacacattctgtataacaggtttatatgcaggcatatgttttttaggagagctggttgttaaacttaccagcaccaccaggggcgtggtgtgtgtgttgttattctcggctcagtcccagagaacagaatcaagtctagttaatataagtagcaaaagatttattgccagatatcaattggcagttccttctcctccttgatatttgcttcctctgtgctaaaattttgaggtgatcacctctgccatatctctccaaatttaactctaagctctttgatactatatagccagaaaagatggggggatgtgtggtgagggatagaaatcctttacaatattttctttaatcagcataatgattacattctgactggcagaaagcggggggtggttcttcatctgttttgcctccattgcttcacctgtgaaatggtaccaatcaccccataaagtctggtaaggatgagaatcagtttagtacatgcttactcagtgagcattcctcccgcaatccagtgcttctcaaagtgcggtggctggaccagcagcaccagcagcacttgggaactcatttcttcttcttttattttttttttttgagatggagtttcattcctgtcgcccaggctggagtgcaatggcacgatcttggctcactgcaacctccacctcctgggttcaagtgattctcctgcctcagcctcctgagtagctgggattacaggtgcccgccaccaggcctggctaatttttgtatttttagtagagatgggatttcaccatgttggccaggctggtctcaaactcctgacctcaggtgttccaccctcctcggcctcccaaagtgctgggattacaggcatgaaccaccgcgcctggcggggaactcatttcaaaatgcaaattctcaggcccacccaagagctactcaatccaaaactctaggaggaagggctcagtgatctgtgttttaacaaggcttccaggcgattccaatgcacactgatgtaggagaacccctgacctaagggaggaattttcaaattttggtaagcatccagacatgtagggtgcttcctgagggaggaattctcaaactttggtaagcatacaaacacatagggtgctttttaaaaaggcagatttgctgtctcaccccagagattgattcattaactctggaatctgcatttgagcaagtgctgtaggggattctaatgcaggggtgctgagccttcattctgagaaaaataatgcggaagtcactaaaggacagcaaggtagggagctcttggccagaagatgaatctggtttgttccttacagtgttttattaaaatctgatttaatcatcaatgtgaagattttatataaaaattctgatttctggcttttgagaattcagaggatcaggcaacaacaagccatattttggtacagcaccccctcccccaccccccgaccctggttggaaatgaaaagcaccagccccctctaaaggactgctcttttctctctttttttttcctgcctggccagcgttttttgagtgttcatctctgggagggagatcaagctgtcccgactcctgtagtttactcatattaccactagagggcaaaatcagctgcgggtggctggacacccctgggacctcagaaagctagagaagatttcctgatggcatcgaaaacttaatgcacactttcaactcatttctaacagtttatcactgggggacacatagtggaactgttctctccatagatgcaattaaagacctactaaatacttgaggaaaccgggctcatgttgtttctctggcacctgcagttcccctatagctcaaaaaaaagaaaaaaaaaagtatgcagtaaagatttcaaatctaaactttacagcttcataaatttttatatatgtatacacctgagtgatcattacccaaatcaagataaaaaacatttccactactccagaaggctctcctgtgctccttcctagacaaaatccccccacaaagcttaatactcttaagacttatgtcaccacaggttacttttgcatgtttttgaacttcatataaatggaatcatacagtgtgtattccttgtttctgacttcttttgctcaactgaatatttgttatttttaattttataaattatggtgtgcatagaataatatgtgaccattaaacatgatactatagaaccatattgtttggcatgaaaagaggtatttgatatattattgagtttcttaaaaagttacaagagtctgttttatgtaaatgaattcgttgatgaaaaattgtagatatacatcttatatgttcatagagaaaagtttgaaataatattcactaatatgttactactagttatttctgagtgtcaggattaatgtagtttttatctctatgtttttatgtctggtttgaatatttttaaactttcaattttggaataattttaaatttataaaaaaattataagaacagtacaaagaactcctgtagctggaactacaggcatgcaccaccatgcccagctaattcagctaatctttttttttttttttttttttttggagacagaatttcactcttcttgcccaggctggagtgcaatggcatgatcttggctcatggcaacctccgcctcctgggttcaagtgattcgattctcctgcctcagcctcctgagtagctgggattacaggcatgcgccaccatgcccggctaattttgtttttttttgtttgtttgttttgttttgtttgagccagagttttgctcttgttgcccaggctgcagtgcaatgatgcgatcttggctcactgcaacctctgcctcctgggttcaagcgattctcctgcctcagcctcccgaatagctgggattacaggcatgtgccaccacacccggctaattttgtatttttagtagggacggggtttatccatattggtcaggctggtctcgaactcccgacctcaggtgatctgcctgcctcagcctcccaaagtgctaggattacaggcgtgagccacaaggccggcttaatttttgtatttttagtagagacaaaataattttgtgttgccatgttggccaggctggtcttgaactcctgggctcaagtgatcttcccacatcagcctcccaaagtgctgggattacagtccgtgagccaccgtgcctggcttatatttagttcttatgcttcttcagttacttgaacttcgtatggtgagtaaataacattttcatttaaaaaaaaaaaaagaaaaaaaaaaagcaccaggctgggcgtggtggctcacacctgtaatcccagcactttgggaggtcgaggcaggcagattgcttgaggtcaggagttcgagaccagcctggccaacatggtgaaaccccgtctctactaaaaatacaaaaattagccgggcatggtggcacatgtctataatcccagctactcaggaggctgaggcaggagaatcgcttgaactcaggaggcagaggttgcagtgagccgagattgccccattgctctccagcgtgggtgacaaagtgagactccatctcaaaaaaaagaaaaaagaacctgaaaccacttgcattaagcaaataaaacaaaatgggataagatgcaattaagagagattttcttcaaagcctggcctacctggagccttaggggttaacccttttcctatgtcccttgctgtgttcagggcagctgtgaagtcctgcggctgttggaccttggggcctccccttcctaccgtagatggatc

SEQ ID NO: 32 - DNA, 157975 bp, Homo sapiens
gatccgcggaattctgatcctcctctgtgagctggtattgctgtttctccaaaaattaaaaatgctcaaaggattataggttttctcctctttcgtatgtttggctctgagacactgcatgttggcacgtttttcattgagaatcctgaaagccacctttccataccaaattcccatctgtctctaccaaattaccagaaaaagaaaaaatgagaaatggaggtctcagattccgtcatcacagcaggtagaaatcaaagtcactgaatccatcaaattagtaagcataccccactgtcagtgaacttcagctgatcagttatgtattgagaaggcaaataacacaattgcagaacatgttcaaaatactagtcctactgctatggtgaacaagctcaatccaatcaaaagcacctttattttggtctctcactgtctaaatttactctctagggcttgttctcccgctgtccctaggtgagatgtagagcaagccctgccctgggcagatgaagtccccgcccaacacaggaactactccttccagccgcgtttggagagaggccgccccttccactgtgggcccgcggggaacctcgctctctgcagggggagagcagcttatgtttggcctcggccttattttatttgcccacttggtgctgtcagctctctttcccaagttgctgagaggggcatgaggtggggagcagaaattcatcgttcgccgatactgctgtgaactggcttcggccgtggtgcattttcatgcgctttgacacgcatgccccctgccctcttctgttggtagctccctcactttgaagggtgcgctccttctggccggccctatctttggctcctggctgtcggggtctcccctctacacactctcttctgttgagtcgtggtgaagcagaaaccccaccgccttcctccatgggttacgataagattcatagcctctcggtggcctctaaaaatcttcctcgaacttccagctcctttatagaccacattcccagcagaagtgtgagctcgcttgggaccacctggtgtcacagtccaggctgctgctggtcctgctcctctacgtggcaatcggcccagagaatatgccttggggggtctcagcagaaactaagatgaaggtaattcaacttcaactccctagttcacaagaaatacgttagctgttttccctaaaaaaggctaggtgaaatagggaatttcatgattttttgtggggggcagggggggtacacaatctccctcttttcacccaggctggagtgcagtgagtggcctgatctcagctcactgcaacctctgcctcccaggttcaagcaattctgcctcagcctcccaaggagctgggattgcaggtgtgcgccaccacacctgggtaatttttctgtatttttagtagagacagggtttcaccatgttgctaaagctgggatccaactcctgggctcaagcaattctcccacctcagcctcccaaactgctgggattacaggtgcaagccaccacgcctggcatatttgatttttaaatactacaagtatttgggtaaaaattaaatttaaaaagtttgcaataacctaacaacaggctataatatgataagccaggggcttcccagcccttttctaatgaagtaactgaagaatgaggagcgttatctagaagtcagggcgaatctgccagagtcaaccaaagacagccccctgcaaacatgaacctgctctctagaaatgtacacaggtttgcgtcccggtggctccggggagaatgtggagccgagtggagtcaggagcgcaggcagccaggggagaactgatggtggcttgggcaagggcggtttcatggggtcggaaggggggattctgaagggagaacgccaggacttgctggggagggttggaaagtaaggaaatgagacatcaaaggagactcctccatgcctgcttgggcaaccaggtgctgccatttactgagaggaggctgactggggacctttgtggggaaagagcaccagcaatttggaaatggcttaatctgagcctgtgagatacccatgtgtttagaaagaatgtcggatggactgttgaatacccaactctgccaggccttgctagacataaggatatggagctatcagcctgttactggtatttaaagccaagaaggttaggtgcagtggctcatgcctgtaatcccagcactttgagaggccaaggcgggagattctcttgagcccaggagttcgagaccagcctgggtaacgtggtgaaaccccatttctactaaaaatacaaaagacagccgggtgcgatggtgagtacctgtagtcccagctacttgggaggctgagatgagaggattgcttgagcctggcaggtcaaggctgcattgcgccactgcactccagcctggccaacagagtgagaccgtgtctccaaaaaaaaaggttgtggaggctgggcatggtggctcacgcctgtaatcccagcattttgggaggccgaggcgggcagatcacctgaggtcaggagttcgagatcagcctgaccaacatggagaaaccccatgtctactaaaaatacaaaagtagccaggcgtggtgcacatgcctgtaatcccaactactcgggaagctgaggcaggagaatcgcttgaacctgggagatggaggttgctgtgagtcaagatcgtgccattgcactccagcctgggcaacaagagcgaaactccgtctcaaaacaaaacaaaaaaagcttctggagccccagttatcacgttcaagttccagatggcagctgatggaggatggggatggcaaaggatgtaccttttccctttaaggcaatttcccaggagtcccatagggcacttcctacttaggcctaattaactgaagttcagccacctgccactcctgactgcatggaagccaggtgcaaggagaaaggattttgaggaggggtgagtcaccagaacacatttgtttgctgcggagagatcgtaaggggcctcggagcaagtccatggggcgtgaggagggctggcgtcctgcgcacagtggaaggactggccttaggaacagggacagtgattccactcagcatagccagggagcggcccagatggcagggcaaggtctctgtggagtgagggcagcagggaaggtgcctcgcaggagaggagagaaaacatacacttccctggggacgcgggcggggagtttgacgggttcggcaggtggcccttttgcagcatctttttcagccgggggtgcagcagtcaccatacagctgaactcggccaggttaaggcggcagaagaaagagggagttgggacttttggaagtaattatgatggctgtggagtctgtgctgggtgaggaagggaagtgactggatagagggtggcagtggaattttttttttaattaaaatttttttcttccccaaccgctccccaccttttttttttttttttttttttaaatagagacagggtctggttatgttgctgatatggtctggctctgccccacccaaaatctcatcttgaattataatccccataatccccaggtgtcaagggagagcccaggtggaggtgattgaatcatgggggcggttcccccatgctcttcccgtgatagttctcacaagagctgatggtttggtaggtcctcctgcgttcattctctctcctgtcgcctagcgaagaaggtgcctgcttccccgtcaccttcctccaggattgtgagtttcctgaggcctccccagccatgcagaactgtgcctcagttaaacctcttttctttgtaaattactcaggctcgggcagttcttcacagcagtgtgagaatggacaaatagtttcccaggctggtcttgagctcctgcggcctccctaaacgctgggattgcaggtgtgagccaccgcacctggccagaatgaaactttggaaggggctgattgttcagataggcgggggtcagtgtgctcggccttgcttctgcaggggaggcacactggtgaggtgccctctagggcagacgagggaggggggttcccggagcagtgacggtggagacaggtgggacgacacagatgggcttgagaggactcaggactgcaatggcaggtgagggggagtccacctgggcctggaccaggtgatgggatgagaagggagggggcgattagctagaggcacaggcttggggaaagagatgacttcctttggacgtgttgagttcggaggcagcctttgttccagagacagagcctggacctgacagctggaagccaaactggaggtggggattgtacgtcactcatagtggaggcactggtgggtgtggagagaacccaggaccccatgagtggctggaggctgcgaaggccgcggggagccaacctccccaggtgaccagaccgctccaagggcttgaggtcacggagggagaagggtggcagccccggccctctcactcagggaggtggagttagagctggagaggcctgagcacgcccctggctcaagaggaggacagatatgcgggtgaggcccggaggaagggaatggccaggtctgaggccctgcatgggctgtggggttggtgttctcagcctccacttttccagtgaaagcagaggatctgtggggagcaaggtggggcagtgtgagctcgaggccggaggacccctgagtgggtctcagtccctacaatctttggagtgttccccttcgctgccttttttttttttttttaaagatggagtcttgctcttgtctcccaggctggagtgcaatggcacaatctcgactcactaaaacctccgcctcccgggttcaagcaattctcctgcctcagtctcccgagtagctgagactacaggcgcccgccaccatgcccagctaatttttgtgtttttagtagatacagggtttcaccatgttggccaagctggtcttgaactcctgacctcaggtgatccacccacctcggcctcccgaagtgctgggattacaggtgtgagccaccatgcccggccccactttgcttttttggttgtggttttttggttttgtttttgttttgatagtctctatcacccaggctagagggcagtggtgcaatcttggctcactgcaacctccgcctcccgggttcaagtgattcttctgcctcagcttcccaagtagctgggattgcaggcatgcaccatcatgcctggctaatttttgtatttttagtagagaaggggtttcgccgtgttggccaggctggtctagaactcttgacctcaggtgatcagaccaccttggcctcccaaagtgctgggattacaggcacgagccaccatggtcagccttcactttgagtctgtaaacgggaactgccaatccttcctcggagataatgaccctgactcagacttcagcccacgtgtcctcccgatatgaggcccatttttacgagttcatcaccttaaacgaggcgccaagtcacagcggtgttgatgcagggcaggttctttgcctggctcaggaaggaattcaagaaccagccggtggtagaagaaaacagcttgattgatggggtggcacgttacggctgtgactggccccgccatgggcagtgtgctgagagtagcagcccagggacagatctgaatccgtgcttattcccatttttaatgacatcctaattcagggggcgggttattcagaaatagctagaaaatgggcggtaacttttgagtgttgccatggccagaggtggtaacttccaggtgttgccatggcaatggtaaactgccatggcactggtgggcgtgtcttagggagaggtgatttcagcacttctggttcagccagtcttcaatctcgtccagagtcagtccctcctgcctcctgcctccgtgctgattgcaggccctgtttcccccaggactccatggcttccgagttgctgactgaccctccacctcagaggtagttctgacactgtctcagttttgcagatgaagatgagattcttcagttctccatgtggaaaagcagctgtggacccaggtctgtctggcccgcctgccgttgtgtgaaggagctcagggcctatggtctgtccacactcgcggtcatcagtggccaagcaggccagggttgctccgcccgtgtgccaggccggccaaggccagttctccactttttctcaggcccatgggtccaagtccgaagccacagaacggcaggaatgaggggtgggagcagagcagtcgagggtgcgcttgaccgtggctgagaccccctgagcagaaacgactcccccaacctctgctgatcctcctagcacccagcagcagtgcttggcacagactctgtccctgcgcatggtctagagggggagatagaccttctagatggcaaacggcatggagagatgactgtgggggcctgggggaggggtcacttatccaaataataattactgagcacccaccatgtgccacactctaagtcctggggtgtagcaggaaccaagcatatgcagaactgcccttcaagggcttgcactttagtgagaaggaaataaaattttataatattaaatgtaaaaccacagtgagataccactacacacccgccaaaatggcgaaacgaaaatgaacaccaccaaacggtggcaaggaggcagcgcacctggaactcccgcacatcgctgatgggagcacaaaatggaacagcactgaagagaggcctggccactcctcaaacacacacctgcccccaaagccagcatatctcctattcgtccaagtgaaacaaaagaacatatcccttaaagtataattaaaaatatatatatatccacacaaacactgtcacagaaacgttcagagcagttttattcacaatcaccaaaagctggaaacagcccaggcatccatcaatggaaaaactgctacatccatccatgggaacctacttgatagtttaaagaaatggcctacttgggcacggtggctcatgcttgtaatctcagcactttaggaggctgaaaccggtagatcaggaggtcaggagtttgagaccagcctgggcaatatagtgaaaccctgtctctactaaaaatacaaaaaaaaaaattagccaggcctggtggcatgctcccgtaatcccagctactcaggagaccaaggcaggagaatcacttgaacccagaaggtggaggttgcagtgagccaagatcttgccactgcacttcagcctgggtgacagactctgtctcaaaaaaaaaaaaagcctactgatacctgcaacaacatgggtaagcctcaaaacttcatgttgaattaaaccagaggcacaagaatacatgccgtatgattccatctagaagaatttctagaccaggccagaatatggtgagaaatgagaataatgattgcctccatggggcgtgcaggtagactggtgaggcccaaggaaccttccaaggggaacgctgtccttttttttttttttttttttttgagtcttgctgtgttgcccacagtcaggctggagtgcagtggcacgatttcggctcactgcaacctctgcctcctgggttcaagtgattctccgattcaggaggtagctgggattacaggtgcctgccatcacgcctggctaattttttctatctttagtagagatggggtttcaccatgttggccaggctggtcttgaactcttgacttcaggtgatctgcccttggcctcccgaagtgctgggattacaggcgtgagccaccgcgcctggccatgttctctatcttgaaaggggtttgggtcacattagtgagtgtacttctcagactcaccaaagagtacacttgacacctctgcatttcattgtttgtgaattttaccctgaaagaaaaaaaaccaaatactgacatgaatgtgaaagactgaggagaaagtgaacagatgtctgcaacttactctgaaattcaacaaaaagggaaaatggacagagacgtaataaagcagatgaagccaactgcttttgagatggaatctcaaaatctctgtcacccaggctagagtgcagtgtgcgatctcggctcactgcaatctccaccttccaggttgaagcgattctcctgcctcagcctccccagtggctgggattacaggcgagtactgccacacccagctaatttttgtatttttagtagagacggggtttcgccaggttggccacgctggtctcaaattcctgacctcaggtgatccacctgccttggcctttgaaaagtgcttgggttacaggcgtgagcctctggacctggcagagccaactgttaatggcagaatgtaactgggtgtaagagggaccactaccattatttcaagtgtgtttgaacgctttcataatgaaatgcccagaaaaattatacagcatattggaaggcctccctgaggagacacttgaaccaaaactcgaggtgagggtgtgagggacacagagatcccggggaaggatgttccaggcaaaggccctggggcatgagcctgacagggattcctagagtagccaggaggccagaggagtagcggggaggcagatcccacggcctcctgggccaccatccatcagcccttggctcttactctaagaggggtatgtggggacaggacagctgtggtcactgtcctgagagcggactgaaggaggcaaggccagggcaggaaaaccagcaaggagacaatagcagcagttctgcaagatgtggtcggggctctggccctggtggcagtggcggccgtggtgtgccatggtcagattctggagaatcttgaaggtggaacagacaggatttgaggatggactgggtgtggagcaggagtggtggaagggggtggtaaaggaaaggaaggagtcaagaatgactctgaggaggccgggcacaatggctcacacctataatcccagcactttggaagcccaaggcaggtggatcgcctgaggccaggagttcgagaccagcctggccaacatggtgaaaccccgtctctaccaaaaatacaaaaattagctgggcatggtgacgggtgcctgtaatcccagccactcgggaggctgaggcaggagaatcgcttgaaggtgggtggcggaggttgcggtacgccaatattgtgccgttgcactccctacctaggtgacgagcgaaattgcatctcaaaaatgaaaaataaataaatgaaaaaggtttttggcctgaaaaggggagacaaaagattccaactggagcacattttaggggaagatcatgggtttgttgtgcacaggtcaagtttgagatgtctgtcagacattcaagcagacacatgaagtagaggtcaggccactggattcaggggtgatggggcaggggagggactgaagggcgagtcagccctgctgactgtcaggcaggggcagagctcacagcttgggacttggggccctcctcctccacgttggcctcagttcagggctgagtctgacaaaagacaggtgtaatcactttccaaggctgacccagttctttggctgctctcagtgggcctggtcacatttaatcttctgtggcactgtgtgtgtgaggtttgtccagtttgacacacagctctggatcaaaagtcggcaaactaaggccctcagttaagtctgtttgttttggcaaataaagttttatccagatccagccaatctcatttaggctgtctaaggccactacagcagaaccaggtggctgccagagaccacatggcctgcaaagcctaaaatatttactgtctggccctttaagggaaacatttgccgactcctctccatctttcattaaacagggtgtggttctgttataggaacacacagcaagctattgaataagacatttaggtggttcccaactttttgctattatgaaaatgttacaataaacattcttacccttgtttccctgggctcctgggcacacacagtggaattcctggtgtgtaggaaagacatgggcatcttcagtttgggtcaattttgccaaattgctctccagtgtagctgaggtcagttacactcccagcagcagtggaaagagcccatctttccacgttcctctaaacttattacctatcaggtgtcctcagccttcagtagttaccagtctttcactgtgtgtagattctcttggatttcctggctgtgagtgacaggtttgctctttttttgtcttggtgctctggacccctgtacaatactgaattgtctttactagccatttgttcctggcttttaagagaatatttcatgttttaccacatagtatagtgttttacctttaagtacatgtttactatacgttgggtttttttttttttttttttttttttttttttttttttttagacaaactctcgctctgtcaccaggctggagtgcggtggcgcgatctcggttcactgcaacctccgcctcccaggttcaagtgattctcctgcctcagcctcccaagtagctgggactacaggcatgcaccaccacgcccagctaatttttgtatttttagtagagacggggtttcaccatgttggccaggatggtctcaatctcttaacctcatgatccgcctgccttggccgcccaaagtgctgggattacaggcatgagacaccgcgcccggcctgtttttgttttttgagatggggtctctcgctctgtcgccaggctggagtgtagtgacacaatcttggctcactacaacctccacctccctggttcaagcaattctcatgcctcagcctcccacgtagctggactacagacacgtgccaccatacccagctaatttttttgtattttgtaatttttgtattttgtattttttgtattttttttttttgtagagatggggtttcaccatattgcccaggctggtctacaactcctggactcaagtgatctgcctgccttggcctccccaagtgctgtgattacaggtgtgggccaccacacctggcctattttttgttgttgttgttttttgtttgttttcagcattttttgttgtttttctgagaaagggcctctgtcactcaaacgatccttcctgagtagttgggactataggtgtgtgccaccaaagccagcgaattttcttatttttttttttttttgagacagagtctcactcttgtcacgcaggctggagtgcagtggcatgatcttggctcactgaaacctctgcctcccggattcaagcaattcttgtgcctcagcctcccaagtagctgagattacagaatgcaccaccacacccagctaacttctgtatttttagtagagacagggttttgccatgttggccaggctggtctcgaactcctggcctcaagtgatctgcccacctcagcctcccaaagtgttgggattacaggcgtgagccactgtgcctggcctaattttctcatttttgtagagacggggtctcactatgtggcccaggctggtctcaaacttctgggctcaaatgattttccaacctgggcctcccaaagtgctaggattacactattactccttcttaaatttctttgaaactctgctcatggattttctgtatttattatctaagtaatacatctatgtaataaggctataaatctgattttttttttttttaaagaaatggatcttattttgtcaccgaggctggaatgcagagctgcaatcacagctcactgcagccttgaactcttgggctcaagcaattctccagtctgggccccccaaagtgctgggattacaggtatgaaccaccacacctggcctgccatggcccccctcccaagttttctttcttttttttttttttttgatggagtctcgctctgtcgcccaggctggagtgcagtggcgcgatctccatttactgcaagctccgcctcccaggttcgagccattctcctgcctcagcctcccgagtagctggaactacaggcgcccgccaccacgcccagctaattttttgtatttttagtagagacggggtttcaccatgttagccaggatggtctcgatctcctgacctcgtgatccgcctgccttggcctcccaaagtgctgggattacaggcgtgagccactgcgcccggccaccaagttttcttagcatatgtatcctcattttttgtttgaactaaataatttttatttatatatgacttcatatttagaataggtttaaatttccacacagctggagcttacgcggcttttgtctgtggccaaagaatatggttgaaactgatttgatatctgttgagatttgtcgtgcaccctagtagttgggtcatttttgtaaatgttccttgtgtgattgaaaataatgtgttggtctcacacaggtctgaaatttaaattttaaaagttaaaaaactaactgtcaggttttctattggggttcattgatcttgattagtaactgtattaacatcctctatgtccttttttttttggttgtttggtttattagttactcaaagaggtcttatgtctccctatgatggaggacctggcaatttctccttgtgttcttaatatattttcagcctcttttttttttttttcgagacagagtctcactctgttgcccaggctggagggcagtggcgcaatctcagctcactgcaacctccgcctagcaggttcaagcaattcttgtgcctcagccacctgagtagttgggatgacaggcgtgcaccaccacgcccagctagctaatctttgtatttttagtagagacagagttttgccatgttggccaggctggtcttgaattcccagcctctagtgatccacccacctcggcctcccaaagtgctgggattactggcatgagccactgcgcctggcctattttcagccttaaaaacaaaaaccctggaacatagaagttcagaactttcctctcttcacagagttcctcctcgcatcatttcatgttgatcctcttatccccagtgtcttctgcctgaaggcctattttgtctgagttttctataggtacatcttttggttagtttttctctagtacaccttttcccatcgttttactttttggtgcccttaggttttaaatttcctcttgtaaatagcatagagctgcatcttattttttcttggccaatctggtcatctgtgttttaagaggtgaatgtaaaccacattttctacctctggttttgtactatatatttaccatcccttttactttgcttcctttttctccctttctgccttccattatagttttaatacccatcactacccttttctctgcattggcagttatagttccgtttgtattcttttggtgatcctcttaaatatctgaaatacacacctgactttacaaagccagacaatgctcagtctctttaaccccctctcaaattgccctctcagtcttccatgttcttgtgtctcatgcatcttgtttctgtggcccacaaattaatcattattattcatattgcatattaaatgcttgtttagattcacatgtttaccaatttgctcaccatttttccatctaatttcttccttttgggttccatgtccttgttactaaactacattctttaaaaattatttcggcggccaggcgtggtggctcacacctgtaatcccagcactttgggaggccgaggcgagtggatcacgaggtcaggagatcgagaccatcctggccaacatggtgaaactccatctctactaaaaatacaataattagctgggggtggtggcaggcgcctgtaatcccagctactgaggaggctgactgaggcaggagaatcgcttgaacccgggaggcagaggttgcagtgagctgagatcgcaccactgcaccccagcctggcgacagaacgagacttcgtccccctcccccctcccccaaaaaaatgttgatcttcagtctgcgcattctgctctggattttaagcatcatttctggcagctctttttcaggaactgtctctgcaggtctttcagtgttcgcctctggagctctgctcgggcccgcgagttctcctggcgttgccatctgtgcccttttccttattccccatcacctgtctctctggtgagctgcttccgatcagcctccaggtccacgatttctcttctgttgtccttttctgccttctcacctcatcctctgagacctgaatttcgatggctctacttttcaattatattattctttttcaaacctgggcgttcatttctagcatcctgttctatcctgtgtctgactgtgcctcccgcaccttctcccttctctcgccctaagccccgtgaaggcgccgggcctttggctccggctgtttcccacggcgcccagaaccgcgtcagtcctgacacagactcggtgagggcgggaagtggtgccgtggggctgcagcctggcccgcccgctccatcggcctagggcggccccaccgccctccgggccttaccttgagttcgggctgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcggtgaggcccggcaggcgagctgcgagctctggggcaggggtgccggccgaccccgactgccgcaggtgacgtcagccccgtgacgtcaggctctggctggaccctcgggctgggaccagctccggcctgggcgggggctgcccgcttccccaccgcgataggtgccaggggctgtggggcctgatggccccgggggtgggggctggagctggggcgtggccgggggccgcccctccgggacaggcggggcggacctgggccggcccgacccggcctcacggtctggccgctgtccgcagccgaccgctgtaaggaggtacagcagatccgcgaccagcaccccagcaaaatcccggtgagtcccgcacccccagccctgccccgcccccgcctcgcgcgttcccgacacgaccccctgcccgcccgccctgctcccaggtgatcatcgagcgctacaagggtgagaagcagctgcccgtcctggacaagaccaagtttttggtcccggaccatgtcaacatgagcgagttggtcaagatcatccggtgcgtgggcagccgccgccaggaggtggctagggtcgggaggggagccgggttcccgccgagaaggggtgggagtggggtcaggggtgatgggaccgggcggtgggcccctgttctggggtggctggaaaggtcaaggtcggggctgcagtcggtgttgggtcagaggtgacagctggggtgagaatgggtgtgaaaggctgggaatcattctgggggtcagggctatgtccgtcccgcagccaagcccctcacagctgcatactctcccgccggctgcaggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggccctgtgcctccagccgcttgcttgggagtggggagggtgctggtggggctgcccgcaccatccccgggctctggcgcacagacttgtgttctgtggccgcggtgctcgctctggaaacccacacctgtgtgtagtgttccagaacattattaggggccaccccctctaggagtgcaatgcagatgtggtctcagggtagacttcataacaaaaaacatttattaagtagccacaatctaacaagccctgctcacctgcctcttctccttcctgtctgggagggggctccttggtgtgcagagccacaaggtgggggtccaagttggggagctcccagttcttccccataggccttgctgtcagtcagccatgggtcccttttggtaccagagacttgtgaccctggactcgaacctcttctgcccaagcactcgcctgctggcaactctggctggagggcttggcccagcttctggccccacagccccctgaggtccatgcagccctgtgccagccaggcctacttgagcacgagcatggcctctgtgccatccttggcggtcaagtagaggccatgtgtgaggtagtactcccgccgcaggaaggcatagaagtaatcagagatgagcaggatctggggggagagagagggtgtgaggcgctgctgggtacctccccctaaacccaggatccctgaactgctggcaggtgttgttggaagacaggaacgcccctgcctggctctggatcacaatcactggagaggccctcctcagggcccccacctcagggcccataattgaccctgcaaggtctggcctctcagaagctgcctggactccccctgcccccacccatggtctacacctccatcccaggctctggcctcgaatgccagcctggtgcctgtgcaaccagaggcctctgccccatcctcccacagccacttccatcccagccaggtccacatcaaactcctcaccttccctctgtcaaatacacttctcccactcagcatccatgcccccatcttccagccaggtgcccaggccacaaaattgccctgacacttctctcatacatcgagccaccatgacctgtcaattccccctaaactcaaatccaccctttggatccatccccacagtcactactctggacagagccactgtcatctcatctcctaaacaacagcaaagcttggtccttgggctccctgctctcaaacccgtgcccaccccattctccctggcagccagagggagcttttcaaaacccacatctgatggtgttacttccagccttcaaatcctccaaaggcttcccaagccttagggcaaagctcgaactccctcgtgctctgagaccttgctagggtccctgtccgccctctcccggctccacctcaccccacggcaggatctttactgtttcttctgcctggaatgttctctccccgttcatctagttgacagctgcttactcttcagggctcaggaaggatcacttgccccccagattagttcttggccccactaatctctactcgataacagactcatcgaaagtgtaattttccattcagctgacagcctgactgtgcctcctcccctggcccggggcctccatcagggcagggtcttcgaatggttctgtcactatggtatttctgtgcccagctcagtctgtctgtcccattctgggccacacacagaagaatcaaagggagcctagaagctcagcccactgtctcttcaaggaggcccagaaaggaatagggatttgccaagggccctatacaccagacccggagtctgcaatcccagtcagcccaagcttcccaagaccactggtccctggagcaggttgggcagggcccagcctcagagaaggatgaggggacaggggctcacactacagacaccgcagctctcaggcacctggaggcctcagaggattggcaccaaccacctggcacagatggggagactgaggcacagagcacttggctatggtcttggggcaagacaggttgagctaagcctgggatctagacctccagaccctgtcctgggcagcttctcactgacctgaaggtaacacaacagcagctaaggagagatcagaggcgcctggaggagttcaggaaggtgtcctgtcaccagcagctctgatggcctcaggacaagtacctgccattctatcaccacagaagcccatctggaaggttgaacaatcctcatcttaaacagatggggaaactgagactcaaagggttcaatggttggcctaaggctacacctggagcactggactaatggccatggacccagaaaggtggtctgcctggggcccagatcactgatgagcacgagattggtcacagcgtcagcaaagcagacagagctcaggcagcccccgaggccctgcccccagctgcccagctggcagctccaggctggcccactggggggcagtgatcacagcaaaggctgacctcataccctgcagccctttctcacccaggcccgagatgccatctgggcaggaggagcccaaagcaggggctgagctcagaggctgatccctgaaccaggtcagctgaggggcaggtgcagtcacaatccacaacaatcaaaacgaagcaactccatgtcacacaataatcatctggacaagaagcaggaagaaaaagattaggttattaggttggaccatatgaaattgccagttttgcagataaaaaaatggttgaatactggcaatttcatatgatccaacctaatataaaacggaaaaacgtacacatggaaaagtaagcatgttatttagaagtaccaacagaaataacagtaagactttaggtagctattcttttcccctataagccttaactttgcaaactacatacatgtattccattgataaaaataaaacttcggcgaggtgcggtggctcatgcctgtaatcccagcactttgggaggccgaagcaggcggatcacctgaggttgggagttcgagaccagcctgaccaacatggagaaaccccgtctctactaaaaatacaaaattagccgggcatggtggcgcatgcctgtaatcccagctacttgggaggctgaaggcaggagaatggtttgaacctgggaggcggagatgcgccattgcactccagcctaggcaacaagagcgaaactgcgtctcaaaaagtaataataaaaaataaagcttcaattaaaacaaatcagccaataaatcaatgaatcaatacatcaatggggggggggagataaatcttccttccagaagaattccaaacaatgtaggtagttatatccccctcccatagaaggagcttaattcttgtccactctgcatctcctaagcctaggggggtctagacttggttactcacttcctcctgaggagcagggaaagggaaaagagtaactttacagtggagagacctggccaacactatcttaaccacgtggtggaggttaacatcagcttgaaatcacgtggctagcatgtaaccccaatagatgtgatgagaagggcactttgcctggggtattctttctaaaaacccacaaccccaggatagtcctaagaaaagcatcagacaaacctaaactgggggacaaacctaaattgggtgacattctacaagatacctggccagcgctcctcaactgtcaaggtcatgagaagtcagaaaagactaagaagaaaagcagaagacactggggagatgtgaccttacatgtaatgtggacctctcgatggggtcctggtagagaaagaggctgtgactggaacaacaggaaatccaaatccattctagtgtttcagactaatagtaacgtatcagggtgagtgtcttagttttgacaaacacatcacggtaaaatataagatgttaacaacttaggcaactaggtgggggcttacaggaactctgttctatctctgcaacttttctataaatctaaagtgattctaaaataaaaagtttatttaaaaaataaatgaactagctgggaatggtggcttgtgcctgtaattccagctactcgggaagccgaggcaaggggatcccttaagcccaggaggtcgacctgggcaacagagcaaaactccagctcttgaaacaggaaaaaaattaacagcaatgacctattgttgtatgtaacaaactcaaaatattttgctgagtgaaagagagctttggcaaatgtacacaaaagatttgcacttttccctgtataataaattttacataagaaaatgatacacatgctgaaatatttagcaggaaatgtactgatgtctgcatttcaatttgaaatacactaaaaaagtaagatggactgagggatgatggaagaagtacctgaagatgtgaatggtggactcccgctggtgggtatgtatatgggtgtccaatgctaaagctgtcaactctgctgtgtgtgtggaaatctggaggataaagggggtggcgggaagagccctgtgagcggcttgggcacacagccctgggtgtcatcagtcctgagtgagcaccctgcccccagggagaggacaccaggctggccgagaggcctggccctttcagagggaagcctgtagccaggacaacctcttctgaccttggggctttccatttgggccgtgaggagagcagggatttcccagaggccctagggtgcagccaacacagcagctgcagacccagagcccctttgcccagtctggacaggggcgagttgggcaaggggctgtggaatttgcatgggcgagtcagcggctgtgtgatattaagtctcttcctgtcccctgggctgcattttcctcatctggaaaatgacagtaataggctctagcttgttaccaacaatgctgggctcctctagtttttttttgagacgaagtctcgctctgtcacccaggctggagtgcaatggtgtgatctcagctcactgcaacctccgcggttcaagtgattctcccgcctcagcctcccgagaaagctgggactacaagcgtgcgccaccacccctggctagttttttctttttttgtatttttagtagagacggggtttcaccatgatagccaggatggtctcgatctccagacctcatgatccgcccacctcagcctcccagtgctggtattacaggcatgagccaccgcgcccggccgggctcctctagtctttgtgccagttaggaccccagaacatgtcactctgtgtcctcaggtctctggatcccacccaatgtggctgaaatactgccttgccaatccccttctcagacttgccctcttctcttcctgcagccacctctctggacacacacacacacacacacacacacaggtgcacacacacgcacactcacactgctcacacatgcacacacaggtgcacacacatacatgcacgcttgcactgctcacacaggctcgcactgcactcacacacaggtgcacacacacaggtgcacacatacacgcatgcttgcaatgcttagacacacatgcttgcacacacacatgctcgcactgctcagacacgctcacattgcactcacaggtacacatacacgcacacaggtgcacacatacatgcaagcttgcaatgcttagacacacatgctcacacacacagatgcacacacatacacgcacgctctcactgctcacatgctcgcactgcactcacacacacacagatacacacacatacacgcacgcttgcctgctcagaagttccctggctccccctgccctgcccagcagcgctgcagctcccacctatccctcagaggctcatctcctgccaggagtcttctctaaccctgcattgttacatggaccctgaagtgaagtcactgcccactggcctcccaaccaaatggggctgcatttgctccagttctatggccccaggcccggcacagggccagctctctctgagttgtttgctggtctgtaccctctcagcgctgcccccagggacggctcggtccacattcctctctatggcagccatgagggctccagggccgcctccctctgggaccatgatgaagagctcatggggcagctagctgataaaggggtgaccagggacagacaggatgaatcagaagtagaacgaaaccctcagaacatgctctagtgcagggcaggatggagagacagggaaatgaatatcttctgagtgtctgccctggtccaggccctttaacaaaaaaacaatattgtccctttccaaccccccagggtagggctgacaatgcctacttagagaagggaagctcaggggttatgggccctgcaaaaggtcacatggtaggaagtgaagagttaggggccagtcctgcctgtcagaggcccaatcctgagttcttccacaaccccctagggtctgcacccacatgaactgagtcctgctacatgccaggcctgtgctgacacctcaggtacctttacaccctgcggagtctgctctccccagttcacagctctgtcactcagtggagagagagagagattgactttttttgtaaaaagccagtagaggttgttaatacagtgtgtcttgaaactactgggctcaggacagcagccttgtccaccaccagggctgcagattcctagagaagcaggtgctatcacccaggcatgtcctggttccccaggcctcctgctgctgttggggacacagacactgacatttgacagtcagcccacgctggggggaatgcatgtggccgtcacagttggcaaagtgcagcagcctctgcccacctgcctgggatccaggaagctgggaggcagaggaggctggcggccgactgtggagctggacagcactttggcgtaacctggcaacccacaggccggagcggacattatgtaggaggaaatggtggaggagaaaactccaccctccagctctgaagatgcaaagtaacaagtgaaatctctggacctcagtgtcagggtctgagaggtcacaaggtgagactgaggatgaggctacaagtaactgtcccttacatggcacttttcacttacatggcacttttcccacattcagtcctcaaaaccaccttcccagtttgaggaaactgaggccaccaccacctcccccagatttcaacctcccctagcctcgtccctggtgccctggatgccaggctcacacctcttacctctgctcttcccagcagtgaggttttcagagcatggatctgatcacatttatcctcagctcttaaagccaaaggtgcagtctggacctctgcataagaggcccttgaaggcctgtggtctgaccactgctgtctgaattgccctcattccctctcaagtggtacagccagtcccactgagctcccagcagcacggtgttcctcctttgctccctccttcctcctctctctctctctctctctctctctccctccttcacccccacccaggtcttgctacctaaaatcatagaacccagttagatcctacccatccctcaggaccccacttagaggccaccttccccaggaagcctccttaacagcccagctctgggctcccagctcgtcaggctgccctgtcctgcccatgtcttttcctttctctccacagaccgagggctccttggaagtacacctctgtctcattcacccctcgcagagtgcctggtgaatagtaggaacctaattaacatttgcaaataaataaattagcttcccaggagttacgggatgtgcctgaggccagcgagccaggacagacagggctggagtcgctatagagtttgggcttccagagccctggccttctgtggcctttgtcctgctgtatgtagcctgggctcttcctgtcactctggttgttggggaggagaataggctgggaagggcctgtgagggacaagcttgggatgctcagtgctggaaggacaaaggaatgaactaagaccttgacagaattacactagttgggaaaagcaaagtaaacacgcacatccagcaggatgaggacaagggctccaggttggccacaggcaccgcatatcgggagcaacgagccttcccacacacagacctgggatcttgcacagcccaggccacacacaaccggcaggaagaaacctgaaatgggtctcgagccaaccccaaatgggggctacacaccactcagccactaatgacccacccaacacgtctccaagcatttcctcataggtcccatttcccagaatgacacaccaggccaactgagaggcaactccgggagacaggattgtggtttcacctgtgttgcagtgaacagtgagtcccaggcaggggacaggcagcatgcaggaggttggtgtcagacctcgggcttcaggcctcactcaaaacagaaaggagaatggccaatgcaaggccagcccagtatctgagggtctgcagtacagggaggggtcagggctggcccctcatggcaaataggcagtggcttgaggagtagggttccagatgatccagatcctgcttggaagggtgggtggttggccaggtgcggcagctgacacctgtaatcccagcactttgggaggctgaggcaggagtttggcttgagctcaggagttcgagctcgtaacaacatagcaagaccctgtctctaccaaaaatttaaaaagtagccaggtgtgggggtgtgcctgtagttctagctacttgggaggctgaggtgggaggacctcttgagcctaagaggttgaggctgcagtgagctgtgactgtgccactgcaccccagcctgggcaacagagcaagaccctgtctcaaaaagaaaaaaaaatgaaataaaattaaaaaaaatttttttgagatagcattttcactcctgtcacccaggatggagtgtagtggcgtgatctcggctcactgcaaccttcgcctaccgggcttaagcgattctcctgcctcagcctcctgagtagctgggattacaggtagcttgccactgcacccggttagttttgtatttttttgtagagatggggttttgccatgttgcccaggctgttctcgaactcctaagctcaagcgatctgcccgcctcagcctcccaaagtgttgggattacaggcacgagctactgcaaccggcctactaaaataaaatttaaaaaaggaagggcaggcagacgagaagtctgctttagatgtagacacagggcaggagtggggctctcaggccagctactgggatacaagggtaagggggctctggctctgaccccctagtaatccagtagactagccagaggcccaaatcagaccaaaacagggattggcacggggaggtcagggtgtacagaaatgtgttagagcattggtcataaaatgtggtttctgatgccagctcattcaatttgtcatcaataagtagtcactgaatattcttcttggtgctggggatacagccatgaagaagacagacccagggctcgccctaatggaacccacagtctactaagaggatgtgacaaacaagactgtggataaatacaccccttcacagcttagtgagtttgggtaagtctctaacccttccaagcctcagtttcctcatttgtatcatgagttaataatagtacttccttcaaagggctgttatgaggagtaaattccttataactaaagaaaaaaaggaaaacaatgtaaagggctgtcagtagagtagttacataaagtgtggtgagttcacatatgcaggactcaaataaaaaggaggttcctctctcacatatgagcaaggaaagttcacccagacattttactaaaagggaaaaaagtcctactttcatcattatgtcaataataaaacacacatacccacatacaaataagcctctctctccatgagcctatgagtttatgtaaatgcacacagaatggttcggaaggccatctgagcacgtgatcagaagattatagggatcacgtggggccagcccctagtaagctctcctgaaacatgagccactgttatttatttttatttttttttgagacacagtctcgctctgtcgcccaggctggagtgcagtggcacgatcttggctcactgcagcctccaccttcagggttcgagcaattcttctacctcagcctcccgaatagctgggactacaggcgcgtgccaccacatccagataatttttgtatttttagtagagacggggtttcaccgtgttagccaggatggtcttgatctcctgacctcatgatcccaaagtgctggaattacaggtgtgagccaccgcgcccggccgcataagccactattaattttaattttaggagaagattttcttatgttctctgtttttaaacagaatgaaggtgagtgtgacactttgccctactcttttaaaaaagctaaatttaaacaagttcctttttgtttatatgtaatccttgattaatattttccacctgctggtcactgactcacaaaataaaagggttaaaaaaaaactgcttcctttggttcatggactgtctctccaggaatctgctctgggtatttgaagagcatgttgctcttgctgtttcccatgtcaacacacatgagtaatggcaacaggacccacaagttatgtccaatcctctcaacaccctggaagctgtgggtcatcatcccggtttttgagataaggaaactgcaacctagagaagttaaatcacttgaggaagtgggggaggccctcaagaaatccactggtctcaatccctccttcgttctctcacactcaggcgcaccccccaccatggatggtttactgttgtcatttcctgttactgactctgaggaacaaccataattagcaaatgaaccatgccacaggcagaaaaataatagctcccagggtaaaggatggggccttagtcactggtttacctgccggtataactaataatccacacataatttgttctgtaatagggtatggcactgaacaactcaaacagagcaggatttaaaaaaaaatctataagccaagatgttctctatattcagctcttgatttcagcaatgatatcaaggttctagatacttccttgaaatctgtactcatctggttcctaagagagctctgctttgtcttgcccaaggaggagaaaatgaggcaggtgaataccaggcaccttcctagctcacagcaggatatggaactgagaacatgtccccaaatcccgtacgtctcgatggaagacacagaagcaggggctgggtttgggctgcgcaggacatgcaaggctgagaaaaagacagtgggacaaggggacctcatgaaaggtctctatgaggaggtgacacttcactcttagtaaaacttgaaatgtctcattttgcactctgaggctcccaacaggtccaaaggcaagggtggcataactttcatgaagaggggctctcttacctcagtcagcgctctgggacaaggacatgcctcgagtgactgcctcagtgagcaagtggccccatctgatgcaccctgttagtgacctggcagcagcagcaacaaagtcgaaagccagcagccccaggaagtacttggaccccctgctgggaggcctgtaggttggtgtggcctgcctgaagggcagcttggaaatacctgccaaaggcgtaaaatgcatatgccccctgacccagcaaatcccaccacgtggaatctactctataaaactccagcatgtgtgtacaagaatatgtggagggatatgcaaggctcttccattttatttatttactatttattattacttttttatttactaattattatttttattatttattgctattgaccagcctggtctcaaactcctgacctcaagtgatcctcccatctcagcctcccaaagtgctgggattacaggcatgagccaccaggcccggctgcaaggctcttacatttaaagtgacaaaataggctgggcgcagtggctcacacctgtaatcgcagcactttgggaggtcgaggcgggcaaatcacttgaggtcaggagttcaagaccagcctagctaatgtggtgaaaccctgtctctactctctaccaaaaatacaaaaattaggcgggcatggtagtgcacgcctataatcctggctactcaggaggctgaggtgagagaattgcttgaacccaggaggtggaggttgcagtgagccaagatcacgccattgcgctctatcctgggtgacagagtgagactctatctcaaaaaataaatatataaataaagtgccaaaataaccaagggcaacctcaatgcccatcagcagggctgtacctagtccaaaccactggatgttacagaggtattaaaaaattatctcaagacaaaatcattaagtgaaaaacagcaagccaaagaatgctacttaaaggagaatgccatttacctacataaacaaacaaacaaaaaaccctctttatgtacctgtgtctatagctgtctataaatgcacagaagaaagtctgcaaagacacataccaaactgatcccaaaggccacgtctgcagaggagtagaaaatgatgggggctcaggcagatcttttcttttcattgcatagtctttttattttttattttttggtagagatgggcttttgctatgttgcccaggctgttcttgaactcctagcctcaagtaatccttctaccttggtctctcaaagagctgggatcacatgcatgagccaccacactcagcccattccatattcttctattttgtttgacttctttcccccagcaataatgaattcatgtattacttgatgatttaaaatacattttaaaaagagattaagaaaaaaaaaggtaagagatcatgccaagagtccagctggtttctctcagctatgaacacacttgatccacctgcctttggtttccatccctaaccccaatccctctttccaataattcagtttctcctgccttcaatggcacctgaccacttgcagacaaccccctgtgctgctttagagtcccttctctcagaaaggcagccacagagaagaaagctgttatctggcaagttccatggatgcttcataatcactgcaactgtatttccagacccaaacttaagactaagactcatgacaagacaacaggctgtggactatttctgtggagcttgccaacctccctagaggcccagggcaggcccaatgcccacccatgccagctaccactggaaggtaaggaaaaggaaggagatcccagaaaggcaggagagccagggcaaccttctggattccttcaggatatgcaattgagccctgcagaattctgcctgcgtgggtcagaagtaagagaggctgcgcatccaccaaccctaactacagtgtgagagacagaacaggccctccggctgggccccacccaggctacaaggccctctatctctctttcttctgctcacaaaccaagacaactggctgggctgaacattaatcctccagaaatgtccatgcaggaaacaccagtcccatcactcactgaaaaagccctaactcctttcttttcccgcagctaaccttggaggcaagaattaccctggggattattcactggcatcattagtctttccagccagcctgcttcccatccaggctattacacataggaaatgcctggctgtgccaatggcaattgaaatggtaaatggtacaagtgattctcaaaagacttccactacgaggccagagcctgacctgagagaaggcagcacgtggaggagggaacttccaagaagcgtgggtgagtccacctagagtttgctagacccactgccacagaacctctggaagagcttattaaaaatataaattcctgaccctgtattccacattgaatcaacatttctgggagtgggatcagagaacctggctttttaaaacagagccatgtacttgggacggctgcaacataattgcagagtttaaagcctgttaacagggaatctgcatttttaacaagctccctctgaggattttgattgagaatcctgctctgtggaacagagggacaggcttcccagctcaggggaaggctgagctccttgctggtactcctcagcctgtgaccacagcctcctctccaccgctcccagccacacaatttatgctcaactccccaacagccagaccggcccccttctcctctgcctgcctttgttcctgctgtcccgagagtccgcagagcctctcctccccttgccttgccctctccccctcactctatctactccctatgggtgctggaaccacaggcaccattacagaaaggggtgcctcagaaatcaagccttatgtgaattttgttcttggctcctccaatgaccttcgagaagagaggacctctgcaagcctctgtccctcatttgtaaagtagggctaacatgccctgtctcctaggcttgctgagaatacagcatggctatggttcagtgtggtgcccaatacatatctgccaggttcagccttacactgctcttacttccccgtcctcactgactgggagctacttgaggggagtaactgtgcctccttcacgtctgcaccccccggtatgcagaatccaaggccatcgttgaatgcttgaggctgcaaaatgaattcctgtccccaagctgacccccatgctgtccctcttacctgcccaacgttgaaggtcagtgtgatggcataaaagaaattagagttggcacttcctgcataaatccagaggtgccacaggacagggaagagcagggaacagacgatgatgatgcaggtgaggacaaagatgtttctcaggactgcaaagacagagggttacagttagcctgacacgctctctctggcatgctttccctgctgcaatggcccccctgaatggagaggcccaaggtgagcatcatgtagctcaaaggcagagcacccccagaggtactggggtgccaagaagcaaaccccagactcctcagtcaatggctccccatgcccacagctggtggtagctcctggatttcgattatttcctcccactgtgggcttggctggctgaagaccagctatagttagaaatgccatgagtgcctcggggcaccaaacagggcatttcaggaagatattcccctcacctcctaatcttggagggtccaagagtatccctctccccaagcagggtgccatctggccatgtgggattatgggtgggaaccccagcatgaaccgtgacgattagagccccactgtgggtctccatggtgccacagtcctgggtcttaggaacacgttttccattctccttaactggtgtcttaggacccctgcctcgctcttcaaacattcccaactctcccttagatgataaaggacctctttttgacaccgtctctcactccttgcctctaagggaatgccgaatcccaccaggaagaaagctctccctgaggtctcaggaaggacctgctactcaagggtgatccagaggcagacaggctggctggcttcagccaaacaggagtgtagcatggcagccgggtacagaccttggttaaaatcctgctctgcatttattagcaagtttctctagacctcagcttcctcatctgtaaactgaggctacacacctagtatgtacttataaaaattaaaaattagggtgggcatggtggatcatgcctgtaatcccagcactttgggaggctgaggtaggaagattgcttgagcccaggagttcaagaccagcctgggcaacatagtgagagcccatctctaaaaaaattttaaaatttaaaaataaaaaatgtttaaaaataaaaataaaatggggctaaaatgcacacttcatttggtaaacaagatgacatgtgaaaaaatgacacagatatatcactggctacattagttttccattgctactatagcaaattcccacaaacttagtgatttaaataatattctttattattaaacagttctggaggtcagaagttccaaaatgggtctcacaggctaaaatctctagaggagaaccccttgcttgccttttccagcacccagaggccccctgcattccttggttcatgacccccttccagctgcaaatccagcaatggtggattgaggccttctcacattgcatcactcagaccttctcttctgcctccctcttccatcttttttttaaaatagactatttattttgagatggaatctcactacattgcccaagctggagtggagtggctggatcatatctcactgaagcctcgaattcctgggctccagggatcctcctgtctcagcctcctgagtagctggaactacaggcatgcacaaagaagcccagtggactttattttttagggaagttttagtttcacagcaaaattgggcagaagatttcccatattccccccacctccacctcttccactttgagggacacttgtgattacactggggccacctggattgtccaggataatctcccctcccaaggtcttaaagtccctttgccatgtaaggcgatgtcttcacaggttctggggattacaacgtggacatctttgtgaggggagggctactaccctgcctaccacactgtactttttcccccgttttaactctctaggggttatcacacaggaggattgtctgttacttttctttatctttatcatatttttaaaaactaataaatatcatttaaaataattaaaagaatacctttttaaaaagaacttagcactgtgcctggttcccagcagacacttaatgaatggaagttcccttctcttctctgatactgaccttcaggaaatcccttctcccaagtgacagttttgagagacttaaagggtggagaaactcccaaacatttaggccatttatattagttgtacaacttagtagagatgctatactgggggctcatgcattgcaaggggcctagatgatacagatgattctcaactcccgctacaaaacaaaatcacggccgggtatggtggctcacgcctgtaatcccagcactttgggaggctgaggcaggtagatcacctgaggtcaagagttcgaaaccagcctggccaacgtggcaaaaacccgtctctactaaaaatacaaaaattagccaggcatggtggcgggtgcctataatcccagctactcaggaggctgaggcacgagaattgctggaagtggagaggcagaggttgcagtgagccgagattgcaccactgcactccagcctgagcaacagagcaagactctgtctcaaaacaaacaaacaaacaaacaaacaaaacaaaatgaaatcacacggagagccctcagactagtcaaagtctctagggtggggttcaggcatccatatgaggttttaaaagcttcccaggtaattccaatatgcagtcgaggctgcgaaccactggattacagctgcagccccttacagtctgcaacagagatgccacccaactgtgtcaaaaggagaataatcaggacacggtagttcacagttctttgtaaagctgaatgttttcaagttacagttcattctttattgagaaatgataggtatcattttgttgttgtcattaaaaagtccttcattttataacatggggaagaatggctggtagttgattgttttaatgtcttcagcaaaataaaaagctggcaatctgtcacccgagtttattgaaacattagtggtctaagaaatcccacaatttggacactggcctggagggcttgcaagatcctcttttctaatctgaagtttctcaattctgggttttcaaagatgagaggccaaaaccctgactcaagcctcctgagacctcccaggaacaaggagtcttgcaaagggacgttttcactgagaattactattattattaaaccatgttactacctcaagaaggagaacaaatgcttcccactcctctaacccaacatcactatgtacatttctcagtggttctttctgatcccctggaaattattttgctgaaaagaatacagactattcccaaaataaaatgtttgcagcctgccagaccaggtggttcttgttctgtgcctccagccagggacacagatttcagacagggtgacaggaaggaaaccaagtgcaaagagacgagagaagctcactggcagcctctgggtgctatctcgaagggctgcaaagatacattcccatgcggctagagaaccatcaccagcatgcagttggcttctggcctgtggtgacctctgcaggaatggggagctgctattcactcttgctggctgacaggccagaagattaaagctatatatgccagagcagatggagctggagacctggggtacgggacagcttgttccaggcatcagaaagcgtcagaggtgaccagggcctaacaaggtgaaaggcttcacccttcatcagacttgcgaggccagatggaatcaggttccccaccacattcactgggtggcttatccaatctctggcaccatgattgatgaactggaacttcaggcaagccactttcccttcagagcctcaggcattcggaaagaaaatctcacctgaaaaatccagtccaatcagaaggggaacaggggggatttggggacttcaaaggccatggtgatattccctttcttaaacgaggtgccaaaacacgtgggaatatattttatcatgattctttatatgtatatctatcaacattcttttatcgctatacaatagtaataaaaacaaaacaaacacacacacaaatccagccctttggtaactggctccttctgctgtaccatgcaggctggcatgggttctgccagcaggctgttccctaacaccacaattgtgcgtctgtatgactcatccaagctccagagagtccagcgtctgggacctacactcagggaggggccacgttccttttctcctctccactgcacaggaaaacagaaaggtgaatgtgggagcatgcatgttagcgctgacagctaatgtttaaatggaattcctagccacattaaatatattcaacgtaggcttaaacacgtctcaacacatacatcccactcataggtcctaaggaccagggctgatgctgctcccagctaataatgattcacagttgtcaagccccaagcaggttctccaagcacgtgtactccctgctgcaggagcagtgaagcaaaggtggacagctactgttctctgcaggatcttcagacaacctgaacctgcagactatgtgccctgccagccagcaaaagcaactattagatcattcaggtttctggaaaccccatccttcttctttgtgcctcctcaccccagagggcataaaatagtttattcgtcttgaaaaatatgtttattctgatgactctggctaccaagcccgaagctctgatcacggaactatgtgagagactcccctgcataattattactcacgatactaactgcagtgctatttacagatattctttctcaaacttaacacactcatgagttattttctttatttgattaatggaaaaatcagatgctcagaaaggttaaatgatgtgcctaagaacacatggggctcgtaatggcaatgccaggaatcggagtcaagtgactctccagactgctcagcaaatgggatgaaagacagtcactgagagagaaagagtgcccagtgtgggatgggcaaccacaaaaatccattctacattcttgaaatccactatcacaaactgaggcatgtccatgttttggtggtctcatggtttgtcactggccactctgccgaggggccccaagctgactctcaacctgctggactgggtgactcttgtctgtgcagagaggatgtcaccacagaagacactgcttcctcctcccagtcaggccagatgggtcacagccccactaggccatcacctgcaggcgtagccctggctcagctgcccacaccactgtttaccttcactcagaggcacactcctataggtaggctgcttcccacagctagtcagtttcacttcctggttgacacccaaaacaacaacaaagattcacttcctctgaagcctgcactccctagttcattcttgacaccttgctggacacccacagcaggcaaggaaagttcaacagctcccttccatgcctcgtttagagaatcaggtggtgctgggccactgacactgcctctttattggggaggtttaaaaacccgctccacaaatgtttgcaaggtcttctatgtgtcagcttcagtcctgagtgctggggacacaaaggtgaatgagttgtgatatctaccctgacggagcccccaaacaatgaaaagaacccaccatagagggctaagagcactgggggcctaggcagcacagataggtcaccactaagccacctctgaagaggggatggttagagcttagaggggttgtcacagtgggcagggaagtctaactttgcccctctgccttctagtaacctttgggtgcagcgctggggaatggttcaaagcccagggcatagagttctgctgtctagtatggtagcctagctacatgtggcttctgaaatttaaattaaaaattcaggttctcaggcacacaagtggctagttaccctattgaactgtgcagacagaggactttttcatcatcataaagccctgctggacagcactgggtaggggttcacagatctggattccaatcccggctcttctaattagaagtcacgtgactttgaatgagtggctctacctttctgtacctcagttttctcatctgcaaaacgtggatacttacctcaaaggctggtgtgaagatcaaatgagctaattaatgcatgtaacactgtgagagccacagtggccaggtacacagtaagtgctcaataaatggcaattatttttatcatcacaagtccgcggcacctggaagcagatattgtgcttcatgcctctgctcccctcctagtgctgccagcataacaggtgcctggtaaatgcctatgaattccttttccctgcagcagtctcatccaggcccaggctgacacaaatctgtggcagaggcgggagtactcacatctgtagagatggttccacacggggaagaaggccatgtagagcgccacgtcccccactgtcgggtaggacttaaagatggcgatgacagcgatctggataaacatgaagaagatggggtgctccctggggcagggcaggggaaagagagagagagatgagtcagggaccaggcctaccctagagactcctgactccatcctttgaaccaaaaataatcctcaggggacttcaggaaggggctggctctgctatccacaaggcatgggccaggccccagtagcagagcagaaaactgcagggacccagaaatacccagaggtggtgaggagggcctggcaaacactagggaaacagcccacagagacatttcccatcaacagtccccctctgcctctgccagctctgggccttcccctaggagccacagaggaagaaaacaaatgaagtcagcattctttatgactgggcttaaatgactgcttggcaggataattaggcagcctcccttgccagaggcccctctgacaattggacgcaaggcaggaagtgcctccttgctgatgccttttttctctaacaacatggtcagcagggtctacagacccatagtgcgatgaacttctttccaggaagagaactgtgaactgcacagagcttttcagttcttaagggctgggactattcttgttaacttaaactaatagcagtttcaattattattttaacctaataataagtgatagcaatgggtatcctctcctgaactccctctgtgtaaagtccttttcctgcatcctctcacgtgatcctcaccacatctcaaccacccctcaaggcaggcaatcctgggccaggcgcagtggctcacatctgtaatcctagcacttcgggaggctgaggcaggaggatggcttgagcccaggagtttgagaccagcctaggcaacatagtgaaatctcatctctacaaaaaatttaaaaattagccgggtgtggtggcatatggctgtaatctcagctattcaggaggctgaggtgggagggttgctggtgccaggaggttgaggctgcagtgagccatgatcaaccactgcactccagcctggatgacacagtgtgagaccttgtctcaaaaagaaaaaaaaaaagtaggcaatcctctcacctgtacttcacagatgaggaaacagattcagagaagtgcactgactgagtaggttagtaagcgatggagttgtctccagagctcttaatcacgcccaataccattctcctgagtgctgatcacacttccaagctctggtcaggagagagttgggggacagagctcaatctcggtgcccctccgagagctgaccaagtgctaaagggaagccaacagggagaggctggatctataccctcctcagctacatttcaaccacatgcacatggcctacttctgcacagtacctagatgcctagcccatgaaggttttcttcagagattaatgacctttttgtcttgcaggtcaaaggtcagggtgactcaatgggtatgaatctgagatgtgcagacaaacatgtccacacccagaatgctccagtgctgctgtgcagcaagtgcctcagaaacgcagcttggcaaaggcgtgcagccctgtagcctctaagaagcgtccagctatagctcagtgtgaacatcttcctaaacacaatccacatcactggcttcaggcttttcaggtagctggtaacaacggcaacatttctatgaaaaggctggtgaaaatgcggtgacaaaaaaacagactacagcctcctgcagcactgcacagggactggggtggcctgaagggccctgttcctacaaagctggcactggaaacaaatcttgcagggggcaggagagcttaggtagagcttcatacccaggcagaagagaagacagcagggagagcaggtctcttcatattttctgtccccacaactgtgtgggcctggcttaggtcataaaatggtgacattattgcctagccaggagcaatgtgtggctttgcatgcagacaataaaagctgccggagagctggctgcacggccagtgcggaaaggtgccctgggatccctgctcctcttcaccccatggctgggcctaaccggaacaaggacagggaaggtggaccacagacagctggagagctcagctgggcaaggctgccagagttccggagcctgccaggccatggaaggagggtgttctgtcagaagccaggccaaggctgtgtcatgggaaggaagcatcagcttttgagattttacagaatgggaaccacgtgcattggtgcacagaccatggagaatggcaggaaggttaggacagagaacttgagctcttgaaacctaaatcaaactctttcaggttccccagaccatctaggcgtatctgtacctgtctgtgtctgttttcccttatctgaagctaggataatagaaccatttccggaggctactaaaagcaatctctccggagcttggcatggtgcagggggataagcatagattctggagccagacaaacctgagtctaaatcccagctccactgcttactagctgtgtgactgggaaaatcatcccacctctctgagcatcgatttcctcaactataaaatgggagtgataagaatctaacgcctacctccaggagttgctaggttaggtatgattatgtttcagagggtctagaaaggcacctggaatggagcaggcctaacatctatcagctctcttagactgcagaagaggactccacacatcctttggagggaaacagatcaggagattaaacagttgcaggtggccagcctcccaactaaaccatccagagtccctgtggaggacctgtcactgggctgttgatggagacattccaccagatacactttttccaaacacactcccctccacaactcctgttcttttttttttttttttttttttttgagacatgcacttccgcctgtcatccaggcagaagtgcagtggcacaagcagctcgctgaagcctcaaactcccgggctcaagtcatcctcctgcctcagcctcccaagcagctgggactacaggggcacaccaccacacctggctaatttttgttgttgttgttgttgtttttgttgagatggagtcttgctctgtcgcccaggctggagtgcagtggcacaatgttggctcactgtgacctctgcctcctgggttcaagcaattctcctgtctgagcttccagagtagctgggactataggcacccgccactatacctggcaaatttttgtatttttagtagagacagggtttcaccatattggtcaggctgatctccaactcctgacctcaggtgatccactcgccttggcctcccaaagtgctgggattatatgcgtgagccactgcacccaggcagccacctggctaatttttaaattttttgtagatacaggatcttgctatgttgtccaggctggtctcaaactcctggcctcaagtgaccctcctgcctcagcctcctgaagtactgggattacaggtgtgagccaccatgcctggccaccgcctggctctagtccaaaacagtgaatgggctcagcagcaatgtggacttgagcacctcagagtgaggccagggaaaatgctggggctccaaagcaccctcactgcagcctgcacccatgcgactctattgcctgctatggcgctggcaactgcggcaactgaaggcaggttccttaggtgagatgctctaaacctgacagcaggtgctccacatttgaaggccaccctcaaggctactagaggcaggggcttctcggacagctctgtacacacagcagcagcaggtccagccacttactttagctttatggctaaggggatggtgtagaagaagacgttgatctgaaacacacatacaaagaagaggctgaagtgctcaaacatctctgcaaagaagtaccagaaaagaccaatgtttggagtgagatctggaacagaaagtctggaattaagaaaacaaagggagagaaaaaagacaaaagttataaattgtctgctttgaccttgatttctcctgaagactttggtcactgctgggcagccaaggacgactttctccctagagagatcaggatgggaagggctctctaggtaccctggatacaggtaattaacaaaaatgagcagagacatataatgataacccataacaaatattagctaagccaaacaaatctgaaatgaggcagggattcatcctaggaataaagagactcacccctgttttactgcgcaagacagtttaaaatcaggagatacccagtactgtaacaaatgagttttaaaacacaggatctattttgggcattctaaagacctgcctagaggaccacgctcaaagatcctgctcctccccattcttactccacaccccacagcaggagtcagaaaaccgagtgcctgagaccgaagtgagacttctaggggctttaggaacaatcggtgggttctggctaagatccccagggtcccagtcttaattgagaaattagggtttaactggaaaactttttgtccaattaaatcagacaaatatttcgctgcaattctggctctcctaaagtttacatttttgatttaaaaaaatatgaagttgaaactgatctcaatacacaattcaaaaaggacaacaaatagggcacgcagagggagagatgagtgatggctcttggtcagatttccctgactgaggcctccgcccaggttaacttttgcctcttgctgtaactatacctccttttctgggaaatgaggtaaagaacacaatccgtggcccaggagaaagaactcttcacctggcaccgcaactcctatctaaggcagagcatgaagagctgaagttagcaagtcattgttatgctcagccaggatttaacacaaataagcagtccagaattccaaatgggagttctgccactcagatcccttccacacatgcacaggtttaagagtctgtcacctattgggctgtgagctccccaaagcttagggagcaaccgagtcttcggcacctatgcagagcctggcacgcagagggcattcggaaatgtttatagaattcatgaatataaactcagacaagcctgcaatactcaagtccatttgagttttccctcaaggtttgacgtgtggcaggtggcattattttcaaactgtcagaggccctcttgcactagaggaacacatccattcctgtttagaattgagcccaaacctcccagttagaggctggtatttgctttggatgttcccagggagtgctctttaacccacttatgctggaggttgcaaatttttttgtgtgaaaaatcagaccttggcgatgaccttgagcagtaggacgtaaataactcccacaagcttcgtgttccaataatagaacactaggcataaatgggttaatcccaccatatcaaaggtgtgtttcagagtacaggttctcaaagtgtgttccctaaaccagcaggccaacagcactggcatcacctggaaaccggagaaatgcaaattgttgatccctccccaagacctacttaatcagaacctctgagggtgggcccagcaatctgggttttaataagtcctgcaggtgattctgatgcaccttaaggtttgagaaccgctgctatttaatataaaggcttcctgtggtccctcaccctctgagtccagctagagctatgaaaaccaaattagcttccagagttttgtcgggggggttttaactgacaacatatagttgtacgaatttatgggtgattttatgtgatgttatgatttctgaatactatgtagaataattaaatctagctagttaacatttccatcacttcaaatattaaacattgtttgtggtgggaacgattgaaatttactctcttagcaattttggtatatacaatactctattattaactatattcaccacactgtgctagtactcaagaaaagaaaagaaaaaaacatattcctcctgagattttgtacccctttgaccattatctccccattctcccaccctgccggcatcggtaaccacccttctactctctgcttctatgagcgtaattgttttagagtccacatataagtgagaacacatgcggtatttgtctttctgtgcctagctcattccacttagcatcagattctccaattccatccctactactgtcataaatgacagaatttccttttttaagactgaatagtattcccctgtgtatatataccaaattttctttatccatttgtttgttgatggacatttagattgattccataacttggctattatgaataatgctgcaatgaacatgggagtgcagacaaatcttcaacaaactgatttcaaaaattttgagtcacctgcaatcccagcactttgggaggccaaggcagatggatcattgagaccagcctggctaacatggtgaaaccctgtctctactaaaaatacaaaaattagccgggcgtggtggtgcatgcctgtagtcccagctactcggggggctgaggcaggggaatcacttgaaaccaggaggtggagggtgcagtgagcggagatggccccactgcactccagactgggcaacagagcgacaccctgtctcaaaaaaaaaagaaaaaaatcctttaagtaagtagccggaagtgggattgctggatcaaatggtaattctatttttagttgtttgaggaatgttcatacagttttccataatggctgtactaatttacattcttgacaacagtatacaagggttcccttttccccacagcttctagaattttctaacgtggtcattacttacataaagccatagactgcggggatgaaatcccaagagctgagaaggaagaaggagaggcaaatgattaccactaggcttcccacatacatcatggcatactcccaagaaaagatccagaaggctttgctcttcattttcacaggtatgtactgccgctggagagaaggcaaagtgatataaacttagggatgtaaacaacagagggcagctattagcttacacttaaagatccctcccgcaaaaccatactatgatacacaggtttataattttgctttggtctttaattaactaagaaggatgtaagtgttaaaaaggtattacgggtgcatcctctgacctcagacctagtaacaccatttctaggtatgtatcctggagacaagttgcagaagatacaaatggaggaagattcattgcaccattgtttggaatatcaagaaaaaatccttcaatagaggaacaaataaattgtggtatattgacatatggtatactatttgccaggttaaatgaatatattgtatctataaatgtcaacatggctagatctaaaaaatatgaggttagttataatagaaaattgctaaacaagcctattatatgaaaatacttatgtgttctgagattataccaaataatactattatttacacacacacacacacacacacacacacacacacacacacacacatctgtaagtttcataaaacatagattagaaggacatatactaaagttatgatagtattagcctcctgggaaccagagaggaaaatataattggaacctaagaaacttcatataacctggcattcatatgcaaaatgaaaagaaataaacaagtaaaaaaagactttaaaaaaacgccaaatttgggttaaaaaaacttcaactttatctgctttcctttgtttgagacagagtcttgctgtgtcgccaaggtagagtgcagtggcacgatctcggctcactgcaacctctgcctccaggttcaagcaattctcctgcctcagcctcccaagtagctgggactgcaggtgcgcaccaccacacccagttaatttttgtatttttagtagagacggggtttcaccatgttggccaggatggtctccatctcttgacctcgtgaatcacccaccttggcctcccaaagtgctgggattataggcgtgagccactgcacctggctttttttttttttttttttttttttgaaacagagtttcgctcgttgccctggctggagtgctacggcgtgatctcggctcactgcaacctccacctcccgggttcaagggattctcctgcctcaccctcctgagtagctgggactacaggtgcctgccaccacgcccagctaatttttatattttcagtagagacagggtttcaccatgttggccaggctggtctcaaactcccgacctcaggtgatctacccgccttggcctcccaaagtattgggattacaggcatgagccactgcgcctggcctcacatattttattaagtatgacaacagcaattatgaaacaatatagcaaaaatcttaatatctgtttagtttgggcagtagacatatggctatcattatacattttctaaatttttcctctcttaaaaatgttttcctcaaaaaaaaaaaaagatgctgggggaagagaaataatttattgttgtaagaaaaaggaaaataagaattaccagaaaacaaaaaaaccaccccagtatgtgagaaaacagaaatgagtttaaacaaatcacaatcaattcaaatgaacaaaactgtataactaaaaatcatgttgtcagggactgggcatggtggctcatacctgtaatcccagcactttgggaggccgaggcgggaacatcacctgaggccaggagttcaaaaccagcctggctaacatagcaaaaccccatctctaatgaaaatacaaaaattagctgggtgtggtggtgtccgcctgtagtcccagctactcaggagactaaggcatgagaatcacttgaacccaggatgcagaggctgtagtgagccgagattgcaccacggctgcactccagcctgggcaacagagcgagactctgtctcaaataaaatagcgtaacgtaacataacataacataacataacataacataacataacataacataacataacataacacaacaacaaaataaaataacataaatcatgttgttaggaaaaaaatcagttatgcagctacatgctatttacaagagatataccttaaaatataagacacagaggccgggcgcggtagctcatgcctgtaatcccagcactttgggaggctgaggcaagcggatcatgaggtcaggagatcgagaccatcctggctaacatggtgaaaccccgtctctactaaaaatacaaaaattagccaggtgtggtggcaggtgcctgtagtcccagctactcaggaggctgaggcaggagaatggcgtgaacccaggaggcagagcttgcagtgagccgagattgcaccactgcactccagcctgggcgacagagcgagactccgtctcgaaaaaaagagaaaaaaaaatatatatatatatgagacacagaaaagctgaaaatcaaaggactttttcagattgccatggaaacattaagcaaaagaaagctagtgtggttatactattatcagataaaatagacttttatgtaaaaaagtattgcagagataaaaatagtccaataatgataaaaggctccattcattggaaaaatataacagttctaaatttgaatgtaactaataacagtctcaaaatatataaaacaaaagtggattaagctacaaaggaaaaatagacaaatccatcatcaatgcataattgatagatcaagcagacaaattagtaatcaaatagaaaaaatgaagcacatttcacaagtttaatctcataagatcttacaaatcatacttatatagagcagggcacctaataactaagtaattcacattcatttcaagcattttgggggtatttacaaaaacatcacatacttaaatcagtccataaacccacattgacttcaaggaatctttatcatacagacttcaatctctgacgataatggaattaatagaaattattaatgaaaagataacgtaaaataaattagaaaaaaacttgctgacctcacatatgtatcacttatttgttgtgagaacacttaacatctattttcttagtaattttcaagtatacaatatattattaactatagtcatgttgcataataaatctcttgaattgtattataaaaaattaaaacacttttccaaataacctaggagtcaaagagaaatgatgtcagaaaatacctcatattactatttgtgtaatgtagataaaacaatactctgagggaaaagtacagccttagaaatttactttggtaggccggcgtgttggctcacgcctgtaatcccagcactctgggaggccgaagcgggtggatcgcgaggtcaggggatcaaaaccatcctggctaacgtggtgaaactctgactcaactaaaaatacaaaaaaattagccgggcgtggtggttgggcgcctgtagtcccagctactcgggaggctgaggcaggagaatggcgtgaacctgggaggtggagcttgcagtgagccgagatcacgccactgcactcgagcctgggtgacacagcaagactccgtctcaaaaaaaaaaaaaagaaatattaaagaaagttactttggaatagaagaaaaattgaaaataaataagctaaacacccattttaagatattagaaaaaacagaataaaccccaaaagaaggaagaaaataataaagaacagaatttgttaaaacagaaaataaaggtacaatataaggaatcaacaaaaccaaatctagttcttagaaatgactcatgttattgatggctttctaataagaataattaagaaaaaaaaaaaaaagagagacgaacaaataaacaacattagaaatgtaaaagagagcataactatagatgtatcagggaggagaaaatattttaaaacttatgccaatgtattttaaaaaaggtgaaatggaaacattctatgaaaaatataaataatttaaatgattaaaaatgcctgtgtaactaaaaagaagtggagatcaaaggacatgacaatgaaatgtaatacatcctgaaccccatcccttcccccaaatcctataaaggtcacatataaattggggagtttgaatttggagagaatatattggataatgttattctatcaaggttaaatttctaggggtgataacagtatcatggttatataaagaatgcctagttcttaagagttacctgctgaattagggttgatgtgtcttgtctgtaacttccaagcaagtaattcaagggaaaaaagaaaaatcaacatatttacatagatatacataatatggcaaaatgataactgaagaatctttaaaaaggtatttataatattatagtactaaatttttctgaaataatgaaataaaaaattagagaaaaaattaattcacaagaaaatagaaaattggcccaggtgtgatggctcatgtctgtaatcccagcactttgggaaccagaggagggtggatcacttgagctcaggagttcaagaccagcctgagcaacatggcgaaaccccatctctacaacaaatacaaaaattagtagggcatggtggcacatgtctgtagtcccagctactccagaggctgaagtgggaggatagcttgaacccaggaagggaagtgaaggttgcagccaatatcgtgccactgcactctagcctgggcaacagagcgagactctgtcttaaagaaaaaaaaaaaaaagccaccaagccactttacgtagataaaaagttcatatggaaaaacaaacatgcaagaatagctaagaaaacactgattaaaaaaatcatgaagggggactagccttatcagacactgaaatataaaacctctataattaaagcagcgcaatattggctcgttaatagagaagtagactagtagaataaaacagaaagtccagcactagaccaaaatacatatggcaatttagtatatgacagtggtggcatatcactatgataaaaattgactttttaatcaatgatgctaggacaacaaggtaaccatttggaaaaggttgaattagacctatctctcacaccattcacaagaataaactccaaatagcttagggatccaaatatattttttaaatgaaatgataaagcactgtactagaaaaaaacatggtgaacttgtctttaactttgatgtagaaaaaagctcaactgtgattgtgccactgcactccagcctgggggactgagcaagagaccctgcctcaaacaaacaaaaaacaccaggcatggtggctcatgcctgttatcccagcactttgggaggctgaggcaggtggatcacttgagtccaggagttcaagaccagcctgggcaacatagagaaaccctatctcaacaaaaaatacaaaaattagccctatgtggtggtgcacacctatagtcccagctatcagggaggctgaagtgagaggatcacttgagcccaggaggttgaggcttcagtgagctgtgatcgtgccactgcactccagcctgggctgcagagtgagaccctgtctcaaaaaatcaatacaaaacaaaactacatacatacttcaataattccactttctagaaatctatcttgaagatatacctccaacaatatgaaaataagtatatacaaggttactcgctgaaacattacttgtaattgcaaaatattgtaagcaatctaaattcccacacactggagagcggctgaataaactatggtatattcacacaatggcgtactacacagccttaaaaaagaatgaggacaatctctattctatctatactgatatggaggaatttccaggaaataatgttaagtgaaaaaaaggaaagcacaaaagagtatctaaagtatgctacccttcatataagaaaggcatataagaggtgggcaaatcacctgaggtcagcagttcgagaccagcctgaccaacatggtgaaaccccatctctactaaaaatacaaaacttaactgggcgtggtggcaggcgcctgtaatcccagctactcgggaggctggggcaggagaatcacttgaacccgagaggtggaggttgcagtgagccaagatcgtgctattgcactccagcttgggtgacaagagccaaactctgtcgctaaataaataaaggcatacaagaaaatatacatataggctgggcgcagtggctcacgcctgtaatcccagcactttgggaggctgaggcaagcggatcacgaggtcaggagatcaagaccatcctggctaacacggtgaaaccccgtctctactaaaaatacaaaaaattagccgggcatggtggggggcgcctgtagtcctagctactcgggaggccgaggcaggagaatggcatgaacccaggaggcggacggagcttgcagtgagccgagatcgcgccactgcactccagcctgggaaacagagcaagactccgtctcaaaaaaaaaaaaaaaaaaaaaaagaaaagaaaatatacatatatacatgtatctattcactggtgtgtgaaaggaatacaggaaagataagccagaaactaaagagaagacagccctccatatccatgggttccacatctatggattcaatcaactaaggataggaaatattccaaaaaaaattgtgtctgtactgaacatgtagagatgtttttctttcattattccctgaacaatacagtataagaactatttacattgtatgaagtattacaagtaatctggagatgacttaaagcataggagaggatatgcctaggttatatgcaaatactatgccattttgtattagggacttgtacatcctgagattttggtacctgcaggaggtcctggaaccaatccaccacaaataccgagggaagactgtaattacctagggtgagaggggagggactagaagaacaggatagcaggaatgatgacagagtaatactgctctttttgtacagctgactcttagaaccacagtaatattttacattcccttcacttaccccctcctcaaataaacaattaaaatcaaccaatatgtggggagaatccaaaatgaatataaaccctaacaaatgaaactaactatattacaaattaaaaacacaaccacactgaagggttacatggcgcaagaaaagaactaatctaagtaattatgaaaaacaggccaggcacagtggctcatgccttaatcccagcactttgggaggccaaggtgggtggatcacttgaagtcaggagttcaataccagcctggccaactaaaaatacaaaaattagctgggcgtggtagtgctcgcctgtaatccaagctacttggcaggctgaggcaagaggactgcttgagcccagtcgggcgatggagcgagaccctgtctcaaaaacaaaacaaaacaaaaaaagttacagtggagaaacctggcagacactaacgtcaccaagtgatcaaggtaaacattagcattgagaagatatggcaatatcatgaacccctcggtacagtgcactgaggacacaatatgcatttttgccaaaaacatgtaaattcagtccagtcatgagaaaactatgacaatctaaactgaggtacatttcacaaaaataacttcacaagtcatgaatgacaagagaagactgaagaactgtctcagactaggacagactaaggagataaaaccaccaaatgcaatgtgggacctaaatatgatcctgaaacaaacaaaaatagcctcagtagaaaatgcaaaattctaataaggtctgtcgtttagttaataatgctgcataaatatcaatttatttgttcttgataactgtatatggttatataaaatgttaacattagcggaagtggagtgagggatacaagaaactctgtactatttttgcaacttttccgtaggtctaaaattaattcaaaataaaaaacttttaaaaatggagataaaaccatctgttacatggttggttaaaaaaataaacaagcaatttaaaaaattagagcgttctacaaggccagtataaaaaaaaatcagccctttgccttgcctctaatcttcattaaatcaagcttgttattgtgatgttcaaatcgtttacatagttattaaatattttggctgtttaatcttactttgagagatttgttaaaactaattacgatggctgatttatcaatttcttctagctgtgtcaattgttattttctaaattttaaagatatcttattagtcaaatacaagtttgaattctcaaaaacaaagcaaaataaacaaaagacaagcagaacttcacgaagatataccactagaattgccaacattaaaaagatcgataccatcaaatgttagtgaagatgtgtggcaactagactgtcatatttggttgggggggttgtaaaatggtgcaaaaactttgaaaaactgtctagtggattctagcaaagctaaacgtacacttgcccaatgtcccaaaaattctgctaggtactgctcaagagaaacaaaaatgttaagtccacaaaaaaacttgtaccagaatgttcatagtagtctatttgtaacagacaaaaactggaaatgggcccaagtttctaccaataggagaatgggtaaacaaaacgctgcacacacaaaaaacacccagcaataaaaaagaatacatgcaataacatggataaatctcaaaaacaagctggttgaaggaagccttatacaaaataatcctattatttcattccatttatatgatgttttagaataggccaaactaatctatggttaaaacaatattcagaacagttgtgtctgaggaaataggagtgggaattgatggggaaaggacccgaagatactttctgtattttgagaggagtttgggttacacaggtatttgtattaagattcatgcacttcatggtatgtaaattctacctaaaatgaaaaagagtgtaaataaataatgaactccagttgatgcttatgctgaattatttacaaggatatgtatgacatctgcaatttacttcaaaatgtatgaaaaataagactgactgatggatagatggatatgtgataaagcaagtatggtaaaatattaatggaggaatgtaggttataggtatatgagtgttcgtatttgttttttctttgaaatttttcattacagaatgttgggaaaatgtaagatttaatacactgtttagcaagccatacatatgtggtaacactttcaagaaaagccaaagaatgattaacaaaaaattcacggtaggccgggcatggtggctcatgcctgtaatcccagcaatatgggaggctgaggtggtggatcacctgagcccaggagctcgagaccagcctgggcaacatgatgaaaccccatcactatatatttttaaaaatatataaataataacaaattcagggtagtcataacctctgaggtagagggaaggagtgcagtgtagaaggaggacgtacagggcttctaaaggactagaaatgttacattacttaagcagggtagtggaacacagtgttgctttattatgttttaaactatgcaaatattataaagcacaagggcattcaagacagatgggacatcatgggtatgggacctgaggtgggatggaacttgccacactggaggaacagagaaggtctgtgtggtttgagatttaggagtgaggggtaagtggtataagataagcatagagaggtagagaacagccaagtcaaggaggagctaagccattttggtaatatacatctcataggctctttaacagttgagaaaaatgtttcaggtggtgagtgttagcacctcttttacaatcttgtgacaaagaaagcaagttccagaccaaattctagcacacctaaagacatctattaaacagatattccttagtgagccaggcccaaagcagttcacacaaactattctagaagctccatgctgtcccagctctttctgcctctagttattccaaccaccacttatgaaaaaggttcactcataatagaactgacaatatcccagaggcagggttctgttgcccttggagtcacatcaggcaaccagaaatcctaaccaaaggccaaaggatcattaaggaattacgcctcaggcgccatctccaagggaagaagttacaggccctgctagattcatattccttcttcatgcaagcataggaatatttcagggtctcgctttgttgcccaggctggtgcagtgacaggatcatagttcactgcattatttgggccctaactcctgggcccaaataatcctcctacctcagactcccgagtagctggaactacaggcacatgctaccatgcctggctaattttttcattttttgcagagatagggtcttgctctgtagctcataagccaccacatctggcccaattctgcttttgaatacttcaatttcactaatgagcgcctacttctaatactcattttgttaatcagtaagacactaatctcaccagtaaaaattggccaggtgcagtgggccatgcctgtaatcccagcactttgggaggccaaggtgagtagatcacttgaatccaggagcttgagaccagcctgggcaacatggcaaaaccctgtctctacaaaaaatacaaaaattagcaaggcatggtggcacgcgcctgtagtcccagctactcgggaggctgagacaggaggattgcttaagcctaggaagcagaggttgcagtgagctaagatcgtgccattacgctccagcctgggcaacagagacccccgtctcaaaaaaacaaaaaaatccaagctgtttctgacagtcactatgctaactagtaaaggtgttgatcaaactatagagagtgctgcactgatggcagcccctggagagtgcacccttgaagatgtaaagctaggtgacatcatggaatgtggatgcttcattaatgtaattcacattcccctgaagttgaggctgaaactaactggcaaatatatactatcagatggtctatgaagaagtatttttaaataaattacagacatcataactccatgataaagactttaaggatgatggaagtcagcgaagagttttaagctggagacagcattactgttaatagatcttaggtgagaggaatctgaccaacgttatggccccccctgtaagctttacacacatagctctactctgacttctccttgcaactgtactgtcccctagccatatgtggctattctaatataaagtataacttaactaaaactaaaacttcagttcctcagtcccactagcaaatttcaagtgcctgatggccacatgtggcttgtgtcttctgcactgacaatacagacacagaacatttccatggtcacaaaaagttctactgataccgctgatctagaagaataaagtttcaagagaatgataaatttctggggatggaaaataattcaaggccaggcatggtggctcaggcctgtaattccagcactttgggaggccgaggcgggcgggtcacttgaggtcagaagttcgagaccaacctagccaacatggcgaaaccctgtctctactaaaaatacaaaaattagctggacttggtggtgggcatctgtaatcccagctactcgggaggctgaggcaggagagatgcttgaacctgggaggcggaggttgcagtgagccgagatcatgccattgcactccagcctgggcgacagagaaaaaagagaagagaagagaagagagaaaagaaaagaaaaaagagaaaagagaagaaaagaattcaacaaagagaaggcatccatagataaattcaatgaagaaagtatttaggttctgagttaattccttgatcatcttgatcttcctcctgaaaaagactgccatttagcaaagaagggaggaagaaaaaaaagaggaagaaaacagcccaggagagaaaaaaaaaataccctctaaagtaaaaatattgttttgtcttcccattccaccctactgatatttaaaaagaagtatgccagggaataaaacaacaaggccatgaaaaactgaatcaagtaggctgttaaaagcagttattggccgggcacggtggctcacacctataatcccagcactttgggaggctgaggcaggtagatcacctgaggttgggagttcgagaccagcctgacaaacatggagaaaccccgtctctactaaaaatacaaaattagccagacgtggtggcacatgcctgtaatcccagctattcgggaggctaaggcaggaaaattgcttgaacccaggaggtggaggttgcagtgagccgagatggtgccattgcactccagcctgggcaaaaagaacgaaactctgtctcaaaaaagaaaaaaaaaaaaagcagttctcttaggcaagtcctgaacacacactcaggaaatgaggtttcactctttgcaaatcccattagtggcccccaagtttctgtttgctaccatttttctcagtgttttattcgacctaaagtgctctcagtgttagactggaaaatgattttttttcttggcaaacttgtggttacaagatgtgcaataaattttaagtataattctgttttgaagacatggttttggagtcaaggtttgcttggggaacagggccctaaaacgataaagtaatttgaagtatgtactgcatctatttataaaaactgaacttgcacttaatcttgcaggactattccagttacacagtgaggcacatctaaaattcctaaaaaagaaactccagcaatcccctgatggcttgttgtttataaacactagagccaaacttaatctcgaggttgtaaaagttgattatataaattgggtcattcttgtcatgtccaacgaaatcagggccaggggaaagaacacccagggcatacagcacctgctccaagaattagattttccacaagcccagctgctgaaacgacctgctgtgactctaagactactttaacctaccactgtctcaccaatcagagattcccagctcccaaaaacttgacttgtgtcaatgagctttctttcaaagcaatacatactatttctttttctaataaaactcctaaccttctgtttgttctttggacataccaaagaccacccagtctgtgtgtataactcaaattgcaattcttgcttcccaaataaaacattagagatttgtctctatattttatttgacttcaacaaggttcacactgcaaatttcccagtgaacaggtgagatttcatcttacctcttttgctccacagcaaacgctgacttaaaacgtgtatgtaaaatgtatgtatgggctgggtatggtggctcacacctgtaatcccaaaactttggaaggccaaggcgggcagatcacctgaggtcaggagtttaagaccagcctggacaacatggtgaaaacccgtctccattaaaaatacaaaaattagccaggtgtggtggtaggtgcctgtaatcccagctacttgggaggctcaggtgggagaattgcttgaacccgggaggcagaggttgcagtgagccgagactgcgccagtgcactccagcctgggcaacagagcaagactccatcataaaatgaaatgaaataaaataaaatatatgtatggctgggtgcggtggctcacatctgtaatcctagcactttgggaggccgaggtgggcggatgacttgaggtcaggagttcaagaacagcctggccaacatagtgaatccctgtctctactaaaaatacaaaagttagccaggcgtggtggtgggtgcctgtaatcccagctacttgggaggctgaggcaggaaaatcgctttaacctgggaggtggaggttgcagtgagctgagattgtgccacagcactccagcctgggcgacacagcaagactccatcttaaaaaacaaacaaaaaaataaaatgtatgtatgtatgtaagtagaagggttacaagaatgatgccctaaaaactctatcaattttttaaaccattttattacaaacacaaaatgcaggaaattacatagaatataaagcttaatgaatgattgtaaggtgaacatccttataaccactaccaaggtcgagagaaagaactttccaggcattccccaagttcctccatgttccctgatccaaccacaatcccctcctccctccaaagtaatcactaccctggctttggtaataatcacttccttgcatttctttatggttttccacttacatgtgcatccctttctatagtttaggtcttgcctatttttaaaatttttgatacaatttttaagtctcttaattcataattcctccactccagcctactcctgcccatatcttttttttttttcttgttacaattcatatgttacagaatctgggacatttaacccatataacatcccataatctggattttctaattatgtaccttgttttcagtatttcttgcaaattgcagctatatccagaggcttgatcaattttggattttatccttttggcaaactttggtggtgggtaatgttcttttgtcaggaggcttggtttttgtttctgatgtcagcagttattgatgctcagtacctagaccataaggggttgtaaaatgatgctatcctatcattttgttttcatttgtaagttgaaataattttataaagatatatttctgtcacctactatatggttatctagtggtacaggaaaggcaggacaaatacttatttttttcctttatccagttttcaatacaatgaactgatttcttatcaattctcctaatttagccaagtaggtttcctttttagtaacattatgagtgcctggatttaaatatatttatgagttttaatctattgcaattcttaccttactgaaactcaaattatccctctttggtcagtgggagcctcttcaagttagatcctaagtcctttcaagatgactccagtagactttgataaactttcatgttatctgttatcacaacattctaggatcatcctatacatttcctgccctaaaacctagaattagccatttccctaagaaaccccagtttctctaaatgggtaaatggtatttcaagatcataatttgggcactaagaatgttcattcatactgggttggtcattgtttctagaccttttagtggacagacacacacacacacacacacacacacaccacacccctacaggggaccaggcaggtaacaaacaagtgaaggtgagagaaatgaaacagggactgtggcaatctgaagagggtacgctctgcctaaaggggacagatcttacaattcctcaaaaggagccagaaataaaaaatttccacatgaatttttaaaatgctgactactaatttcaaaaaagtcaaacaccagggtcaaatgaaccacatctgtggggccagatgtgatccaagggttatgtgcaccctcaacctgaaaatgttaactcgcagttacaatattccaggagtcacattgttgctaatatataaaaaatatttagggaaattaagaattctcagactgcttcagaaaaaccccagctacattaagattatcttcctctccccaagtctctacagcactagggagaaaagcattttctgtacagaaaccatttcctttctcagacacgatgtgaaagggaaaaagccagttatccaaataaactcttaaagggagttaacctaacaatgtttttacatgtaagttcttggaatcacaagaagagatccaggagatatattttgcatgacagatatattagaggaaacaaaactggtagaaaactttattgaaaatgcttgatcaagctcttgccttcatttttacccattccaaaaagaaacaaagctaacagcactgctacctctgccctagcacacacctggacatagcagaaataacagaaagtgactggggaagaaaaaataaggtgtgaaaactctaaatatggccccagagaaggcttggggaaggacccgttatcaagaaataactgattgagtttggctcctctggtataagctaccatcacataacctgacccaagctccagaaaggataaaaaaaaatcacaggattaacgttttcagttcaaagacaagaaaaggtcagactggattaaagcaaaaccaaaagagtactcacggggtaatttcccctagtgtctgctactgtctttgaaagaaaataaaggcctcaaaccatccaagggaatccaaggctttaggaatcccaagcaaaaggaagatgggaactagaaacttcccagactgcaccatgagcatctcggtaagcctcgcctggtctccctcgaagccttacagcttcagcttctcggtcctgtgcactcggctttccttcactggagcctcctgcccctgagcatgttagggctatttttttccgcatgctatcaaatcataacattttaaacctctctctaatttggaaactaggctctcagccaaggtcagagaaagagttgagttgccggatggaaccagatgggctcaaactaccattctcataagtgattcaccagggagccagatgcagcatcccctccctttgatcttgtgtctcatgaaggaaaggaagaatagtttcacctctggcactgatcagacaccagtactctctagaaattccaccagcagaatggaggcatgtttatagtgtcaaaggaggaagtacaaactaacttttacagttcctttgacttcaaaagatgaattattttcttttcccctcatcgccccacatactggtgatcatgtcctttcatgaacatttgaatactaataatcatagctaatatctatcaagccctcatcagactctgttctaaacacttgacatgtattaaccctttgcagtaggtactattatattatccctgtggaagcagagaagttaaatagtcacttgctcagggtcacagagttaataagtgtccaaatgaagacatcagagcctgtactctatttccctcttttttattataaattttttcaaacatgcagaaaagttggaagagtaatacaataattaaccatatatgtctagattaaatattaataccttgccttattttatctttctgcatgcatatatttatttttgctgaaccatgtaaaagttgaacacatcatgacatttctctccaaaacacttctgcacacagttgtgcaaaataaggacattctcctatataccataatactatcatcacatccaggtaatcaacaattcccagccggcgcagtggctcacacctgtaatcccagcactttgggaggctgaggcgggcggatcacaaggtcaggagatcgagaccatcctggccaacacggtgaaaccccgtctttactaaaaatacaaaaaattagccaggcgtggtggcaggtgcctgtagtcccagctacttgggaggctgaggcaggagaatcgcttgaacctgagaggcggaggttgcagtgagccgagattgcaccactgtactccagcctaggcgacagagtgagactccgtctcaaaaaaaaaaaaaaaaaaaaaattccctaacatcatctaatatctaatctgtcttcaaaattttctagttgtcccccaaaacatcctttatagctgtttttttcaacccaaaatccaatcaagactctcccattgcattcagttattgtgtctctttagtccagaacggtttctccactttttctttttcataacattaacattttgaacagactcagaccagctttcttaaaataccatagtacattctggtttgtcttactgcttccttgtggtgtcattgaactcgttcctctgctcttttattccctaaaaccaaaactcagatcttaaggcttcattaagggtaactttttgggtaagaatagttcagagttgataacgtgtattttgtactgcctcatgccaagcactatatatatcatgtcaagttgttccactataagtgataagagttggattacttagctacagaatatgcctttgtaaagatttttgtttgtttgttttgtttcgtttgtttttgagacagtctcttactctgtcacccaggctggagtgcactggtgtgatctcagctcactgcaacctccgtctcccgggttcaagcaattctctgcctcagcctcctgagtagctgggattacaggcacccaccaccaagcctggctaatttttgtattattagtagagacagggtttcaccaccttggccaggctagtcttgaacaactgacctcgtgatccacccgcctcggcctcccaaagtgttgggattacaggcgtgagccaccatgcccggccataaatatgtatttttccctttgctattagcaaagaatctagagggtggggactagggaataatgttttgacacaatgcaaatgcaaatacattgttctctaaaaaccattcacccagtgattttagcatccatgtgatatgcacaagaggcaggtagaaaagggccgttcctggcgacggccccaccctcaagcctggacccctgacctaaagtgagaacttcacatccctgttgccttttccaaaaccaccctggcctggcctgccccgcatcctgtactcataaaaaccccaggctccactggcagtggagtggcagagagggagagagaagcagcagccagaagtcagagggaagcagcttgatttcagacggacaccttgatggcgggacctcggagaagagttcagccaggaatgaccgaactgaggggaagaccaccttcctgctccatcccctttccagctctccatcccattgacagccactttcatcagcaataaaatcccctgcatttaccatctccaattcatttgtgcaacctgatacctcctggatgccaaacaagaggttgggatacagagggctgtcatactgagatgtgaaatgcttaagccatcagaggatggcaaagctgaaagagcacagtgtaacaaacaacttctgtggctccagggatcatgagtaccccactagacattgctgtgggactgcacagagttgtgcacagagtctgtgccatgggactgcacagagttgtgcccagactggtcttaaactcctgggatcaagtgatcctcctgcctcagcctccctaagtgctgggactataggtgtgagccactgcacccagctataattcctttttaaaaggcagagtaattgcttagttctttccttttaattatttactttcagagtgagaaactggtaaaatagccacatctgatgatggtctatgtattttttctcttcttgcccttttagtgagcatcactatggagacatgacttttttttttttttttttttgagacaagaatcttgcactgtggcccaggctggagtgcagtggtgcgatctcggctcactgcaacctctgcctcccaggttcaagcgattctcgtgcctcagcctcccaagtagctggcattacaggcacccaccaccatgcctggctcattttgtattttcagtagagaaggagtttcaccatgttgtccaggctggtctggaactactgacttcaagtgatccacctgccttggcctcccaaagtgctgggaatataggcgtgagccaccgtgcccagccaaacacatggatttttatccagtgttttataattacttgttgtcattcttttgatgctcagaaattcccaaatttgggtggtatgagcccctttcagctggtaccagtgtttttctgacttagtcctgttaagactttgaggactattttgcttttttttgttgttgtaacaagatgtcccagtcaagctgtgctcttacatactacattagacaacctttcctagagggctatgcctacagagggcttgaaaaaaactcagagaaaaagataatgtcaagagcagatgtgtcagctcctagaggttatcaaatccattttgatttggaagtagaaagcattctgaagccgatcagggtacagccactcactctggcacttacagctttgctacaactccccagcaagtggccattcagcctctggcctaaacaccatgattcacagggaactgacctcacttaggacatctcattctgtcacagaactaccttatactaagcttcttgtaccacctaaccattagttctagcttctctccttggagcctatggatccctgtgaaactcaactctaaagggtccacttagtagtctggcagaaactcagccctaaagaataattttaggctggttgtggtggctcagcctaatcccagcactttgggaggctgaggcgggaggattgctgtagctcaagaattcaagaccagcccgggcaacaaagtgagaccctgtctctaaaaaaaaaccaaccaaccaaccaaacaaacaaaaaacaaaaaacaagccagccatggtggcacatgactgtagtcccagctactcagtaggctgaggcagggggactgcttgaacccaggaggtctaggctgcagtgagccatgttcacagcactgcactccaacctagttgacagagtaagaccctgttacaaaacaaaaaagaatatttcctcttctgtttccaccttcactttttttcaccttttttgttttttttttgtttttgagatagagtctcactctgtcacccaggcttgagtgcagtggcgcaatctcggctcactgcaacctccaccttccgcgttcaagcaattctcttgcctcagcctcctgagtagctaggactgcaggcacatgtcaccatgcctagctaatttttgtacttttagtagagacgcggtttcactatgttggccaggcttgtctcgaactcctaacctcaggtgatccacccaccttggcctcccaaagtgctgggattacagacatgagccattacacctggctcctccttcatatttaaacagatggttttgtttcctggatgtgactacactgatcttcaaataccctaccatgacccacaaggcccaggtgatataatttggctgtgtccccattcaaatctcatcttgaattgttgttcccataatcccctcatgtcatgagagggacccggtgggaggtaattgaatcatggggatggttacccccaatgctgctgttctcctgatagtgagtgagttctcacaggatctgatggttttataagggtcttttccctctttgcttggcacctctccttcctgccatcatgtgaaggtggacgtgtttgcttccccttcggctatatttgtaagtttcctgaggcctccccagccatgtggaactgtgagtcaattaaacctctttcctttgtaaattaccaagtctcaatatcatactgaatggacaaaagctggaagcattccctttgaaaactggcacaagacaaggatgccctctcttaccactcctattcaacatagtattagaagttctggccagagcaatcaggcaagagaaagaaataaagcgtattcaaataggaaaagaggaagtcaaattgtctctgtttgcagatgacatgagtgtatatttagaaaaccccaccgtctcagcccaaaaactccttaagctcataaacaacttcaacaaagtctcaggatacaaaatcaatgtgcaaaaatcacaagcattcctatataccaattatagacaagcaaagcgccaaatcatgagtgaacgcccattcacaattgctacaatgagaataaaatatctaagaatacaacttacaagggatgtgaaggacctcttcaaggaggactgcaaaccactgctcaaggaaataagagaggacacaaacaaatggaaaaaaattccttgttcatggataggaagaatcaatatcatgaaaatggtcatactgcccaaagtaatttatagattcaatgctattcccatcaagctaccattgactttcttcacagaactagaaaaaactactttaaatttcatatggaaccccaaaagagcctgtgtagccaagacaatcctaagcaaaaagaacaaagttggaggcaacaagctacctgacttcaaacgatactgcaaggctacagcacccaaaacagcatgctactgctaccaaaacagagatatagaccaatggaacagaacagaggcctcagaaataataccacacatctacaaccacctgatctttgataaacctgacaaaaacaagcaatggggaaaggattccctatttaataaatggtgctggggaaactggctagccatacgcagaaaacagaaactggacccctttgttacaccttatacaaaaattaactccagatggattaaagacttatacgtaaaacctaaaaccataaaccctagaagaaaacctaggcagtaccattcaggacataggcatgggcaaagacttcatgactaaaacaccaaaagcaattgcaacgaaagccaaaattgacaaatgggatctaattaaactaaagagcttctgcacagcaaaagaaactatcatcagagtgaacaggcaacctacagaatgggagaaaatttttgcaatctatccatctgacaaaggtctaatatccagaatctacaaggaacttaaatttacaagaaaaaaaacaggccaggtgcggtggcttatgcctgtaatctcagcactttgggaggctgaggcaggcagatcatgaggtcaggagattgagaccatcctggctaacatggtgaaaccccgtctctactaaaaatacaaaaaatgagccaggcatggtggcacgtgcctgcagtcccagctacttgggaggctgaggcaggagaatcgcttgaacctgggaggcagaggttgcagtgagctgagattgtgtcactgcactccagcctgggcaacagagcaagactcaagtctcagaaaaaaaaaaaaaaaaagacaaaaaaaaaaaaaccaaacatcaaaaagtgggcaaaggatatgaacagacacttctcaaaagaagagatttatgtggccaagaaacatgaaaaaagctcatcatcactggtcattagagacatgcaaatcaaaaccacaataagataccatctcacgccagctggaatggcgatcattaaagtctggaaaaacagatgctggcaaggatgcggaaaaataggaatgcttttacatttttggtgggaatgtaaattagttcaaccattgtggaagacagtgtggcgattcctcaaggattagagccagaaataccatttgacccagcaatcccattactggatatatacccaaaggattataaagcattctactataaagatatatgcacacgtatgtttactgcagcactacttacaatagcaaagacttagaaccaacccaaatgcccagcaatgagactggataaagaaaatgtggcatatatacaccatggaatactatgcagccataaaaaaggagttcacgtcctttgcagggacatggatgaagctggaaaccatcatccttagcaaactaacacaggaaccgaaaaccaaacatcgcatgttcttactcataagtgggagttgaacaatgggaacacatggacacagggaggtgaacatcacacactggggcctgtcatggggtgggggacaaggtgtgggagagcgttaggacaaatacctaatgcatgtggggcttaaaacctagatgatgggttgatacgtgcagcacaccatggcacattacataggtttgttatacctatgtaacaaacctgcgcattcagcacatgtattccagaacttaaagtaaaatttaaaaaaaaattatttcatgtaccatcagcaaaaacaaataaataaataaataaccaagtctcgggcagttctttttctttccttttcttttttttttttttctttttttgagacagagtgtcacttcatcacccaggctggaatgcggtggtgcgatctaggctcctgcaacctctgcctctcgggttcaagcaatgttcctgcctctgcctcccgagtagctggaattacaggaacactcccccatgtctggctaatttttgtagttttagtagagacaaggtttcgtcatgttggccaggctggtctcaaactcctgacctcaagtggtccacttgcctcagcctcccaaagtactgagattacaggtgtaagctaccacgcctggctcaggcagttcatagcagcgtaagaatggactaatacaccaggctacttcatatatttataaaaaatatacaaatatagtaggaaatggagttttaatttctgcataaatgggatcctgaagttcatctcaaactccttccgctcctgtcccccacatacagacggttaccaagcacagccaattctacctcctagaattcccctgcatctagtctctcatctctccatctcctctgacactggtttgggcccccagtttacccctctgacttgatctagtacaatgttctaagctttcccaacttcagctcttcctactcccatctacccgacaagctgctgccaaagcaatcttcctggagcactcacctgctcagcatccttcaattgctttatgtctgcagtctggcatagtatctagcacactataggtacttagtaaatattggtagaggagctgcttgacttaatgagtcagttgtactgtccactagtgtcaggaggaaatttcctttagttttaaacaaaagttgttttatataaagtggtgcatagagattggcttaagaaaccatttttatcttcttttatttacttattcattttttgcaggttggacaagctcagaaaccatttttaaatttctggtccatccatgtgtatgaatatactatattatttatttgatacatagttgtataaaaagtctggctatatatattcttagtgcttagactttctaaagaataagccataaataggaaataaaaaagaaaatacaagcagcacattgttatgtggaaaaatgcttcaactcagcaagaatacagaaagaaaatcaaagcaaaataacttcactgtatggtgacacatctactgaactggcaatcataaatcaaacttgaaaagtcagtgctggcagatgaggaggtaagtggtccacttctctttagatactgatggtggcactgcaaactggctcaggctttctggtgaacaatctggtataattgcctaataagaacaatacgacttttcaccttgggtccagtgatttagctaaagcaacatacttgaagaaaataatttcaagctgggcacagtggctcacacctgtaatcccagcactttgggaggccaaggcagaaggatcgcttgaacctaggagtttgagagcagcctgagcaacatggcaaagccctgtctctacaaaaaaatacaaaaattagctgggtgtggtggtgcatgcctgcagtcccagttacttgggagggtgaggtgaaaggattgcttgtgcccgggaggttgagggtgcagtgaaccgtgactgcggcactgcacatcccatcctgggcaacagagtgagacactgtctcaaaaataagaaaaagaaaaagaaaacaaataaaaacaaatttctggctgggtgaagtggctcattcctataaacctagcactttgggagaccaaagtgggtgggtggatggattgcgtgaacccaagaattcgagaccagtctgggcaacatggcgaaaccccatctctacaaaaaattagccgggtgtggtggcacacacctgtagtcccagttactcaggagactaaggtgagacgatcgattgagcctgggagatggaggctgcagtgagctgagattgtgccactgcactccagcctgggtgacagagcaaggacctgctctcaaaaaaaaaaaaaaaaaatttctacgttatttatattagtgacaatataaatgacatatctcaaacataaataaagacatatctcaaattccccaaataagaaaaagatcaagcaaaccatgaatcattgtctgcatcaacacaatattataaaatcacttaaaataacatgcatatggcctatttcaataaatggaatacacactcagctttagcagtgcttgtgattaagaaaggctctgaaatcagacatttctggcactgccacctgtacactttcaagaaacatttatcttgtaagaatggatttggaccatgtggggcctgcatgcagttacttcctcttgaagaaacatgtatgtactattctcatttgagtagaacaagatgattagagagcacgctctggcatcagatggccatggttcatatcttagcaatgtcattcgctggtcctgtgaccttaagtgacttaacctcccaacattctagtttcaattcatttgtctaatatggctaacactagactaatatttggctaataatatgacctactccataaagttcttatgaggttaaaatgagacgatgcctacagagtgcttagcatggtgcctgacatgtaatccattctcagtaaatgtcagcaatttgcattcttcaattaatgtttattgatcagccactatgttccaagcattgtttcagatgcacatactccatttaagtcctataagaatcttacaaggtgagtgttattataaagaaaagttaaagaaatgagctcagaggggatcactagttgagaaaagaaaactgcaagatagttgcgtttgcaaatatgtaaaataaaatgcacttatacattcccaaggatatgcatatagtagtgccccccttatctgaggtttcacttttcatggtttcagttacctgttgtcaactgtggtccttaaatggaaaattccagaaacaaacaattcataagttttaaattgtacaccattctgagtagtgtgatgaaatctcacgccgtcctgctctgtcccactcgagacatgaatcacccctttgtctagtgtatccctgcctgttagtcacttagtagttgtctcagttattcgacagaaaaaacatagtatacgtagggttcagtaccaaatgcagtttcaggcctccattaggggctttagaacatatcccctgcagacatggggaggtctactgtagttgggacttaatgataattaagtccactttgtttaaagttagtcaagtttctatgtgtttatattttcaactgggagcaagcttcccactgcctttactaacccgtgcccttcctttcccccagcagggaccaggccatgtattaaatgtcacttgggtgctggcttctgaccagcaagtgcttacctggaggagatagaggagtcctgggacaaacaaggtgagtgggtacagagactggtatgtcgctaaggcaagaaaaatagcactgaggaaagcactgcctgtaaaaagaaagaaatgtatggaataatccagcctcatcaatcatgattagactcagcaagtccctctcaacacaaaactttccataactgctcaaataatcacctgccaagtgcctcctggtacacaaggtgctatgcaaattcacacagtaagagcttcttggcttgatttccaatgaaaggaaaccaagaaagtcaaaaccatctacctttggcaacctgagacactacaggcataattcttataaaattttgagacccagaacgattttacaaaatttcaacccgaagatgtataaagggatcaagtctattaacatccatgtcctatctaatgtaccaatttattaagcctacaattattgcttatgatatccagagctggaaacccatccctttgactgttgcaacattatcactctttacaacagcccttccttacctgctgcatcaatttaggtcacgttttttcttttcaaatgaaagtatattaattttgttagtaatgtcctcacttcctatataaaatggactactatggaatcattaaacatgaggctattaagaatttgcaatgacttagaaaggtgtttataatatcctattaaatgaagtttataaaagagacatatattatcatttattttataaaaaaaaaatgcacaaacattttttaaaagacgaaaagccagcaggcaaagtaactcacgcctataatcccagcacttcgagaggccgagtcaggcagatcaagatcaggagttcgagaccagcctagccaacatggtgaaacctcgtctctactaaaaatacaaacattagccaggcgtagtggtggtgacctgtaatcccagctactcaggaggctgaggcagaagaattgcttgaaactgggaggcagaggttgcagtgagctgagattgtaccacagcactccagcctgggtgtccaggcaaaagtttgcagtagggggcggagccctcatggagaacctctgctagggcaatgcggaagcgaaatgtggggtcggagcccccacacagagtccctactggggcaccacccagtggagctgagaagagggtcactgtcctccagattccagaatggtagatccaccgacagcttgcaccgtgggcctggaaaagccacagacactcaacaccagcctgtgaaagcagctgagagggaggctataccctgcaaagccacaagggtggagctgcccaagaccatgggaacccccctcttacatcagcatgacccagatgtgagacatggagtcaaagaagatcattttggaactttaagatttgtctgccctgctggatttccaacttgcatgaggcctgtagcccctttggtttggccaatttctcctatttgtaacggatgtatttacccaatgcctatacccccattgtatctaggaagtaactaatttgcttttgattttacaggctcacaggcggaaggcacttgccttgtctcagatgagactttgggctgtgcacttttgggttaatgctgaaatgagttaagactttgggggactgttggaagggcatgattggttttgaaatgtgaggacatgagatttggaggggctgaggcagaatgatatggtttggctgtgtcctcacccaaatctcaacttgaattgtatctcccagaattcccatgtaatgtgggagggacccaggggaaggtaattgaatcatgggagttgctggtctttcccatgctattctcgtaatagtgaatgagtctcacaagatctaatggtttatcaggggtttccgcttttgctttttcctcattctctcttgccaccaccatgtaagaaatgccttttgccctccaccatgattgtgagaccttccccagccatgtggaactataagttcaattaaacctctttctttcgtaaattgcccagtctcggactaccaaaaaaaataaaataaataaatagaagactaaaacctaaggccacaaagtttatagtggttatctctgggtagtggaattatgaacaatttttcatttttgcttcactgcattttttaaactttctaaaatgaacatgctttgtttttgtcattagaaaaaagctaatttctttgaaaaaatagctattccctttcagatggcttaagacaacaggatactctaaaactaaggatagagagccctagtttacaacaggagtttccaagtggcccagaaatcagtaggatgcaactgatggtccaagatataaagcccaacaggtgtcttgtaatgatgttttttaaaatgacaatacccatgctcactctcattagtgtggggtcaactatttactgaaaataacaggcggggcatggtggttcacaaatgtaatcccagcactttgaaaggcaaaggtgggaggactgtttgaacccaggagttacagactagcttgggcaacatagtaaaaccccatctctacaaaaataaaaataaaaaaataagctgggtgtggtgttacacacctgtggtcccagctacttaggaggctgaggtgggaggatcacttaagccctagaggttgaggctgcagtgagctaagactgaaccactgcactccagcctgggtgacagagtaagaccctgtttcaaataaaaaaataaaaataacacatcctctcaatggtgtttcataaaaggaggaactagtcactccagtccaaggagttttacccctctgctaatccagctctagagacaaacaggaagagattattgatgagatctttcaccaccaaagtggtctgtatacttgaaacatctaaaaactaccttggaggacagacggttataaatgtgacaatgtcacagacgagagagtggagagaaaagaactttgtgtgctttattcttcaaaccaaggaaactcaccagctagaacaaccctagttgacagaaagtagaagggaggcagagaaagagagaagctagaagtaataggacagaattctatgggaaggggggctgtctcgccatattgacagtgccagtcatgatgtcctgtatccagggtactcataaatatgactgtgtaggaacaggatcacgcccagctaagctgtgacaccagcagtggcaagcacacatctgctgagccacagactctaaactcagaaccaggtcactctgggatagggcagtggcagtagtaggaaaggtgctgttctggagcccaacagctagggtgggctagggattgattctttgattgggtcaaaaatctgaatgattttttggtgggaaactggccaagagagggaaaacactgaaaataactttttaacttaacctggttctctacggattgaaagcaggcgagagaagaggcccatgtgtctgttactagaggatggaggctaatgctccaactccatccattcctatagcatggtgaaaacaaacacatgactttctcctgtctctcccagaggagacacaaggagtgaaatcaacacagccatctcttgccctaattgcctgaggttaataattgcttgtctgaaactgactgtttatgaggcccaagagagaaaaagaggctcacagcctagccaaatggacttgtgagttttagaatacttgctcctaggatcaggaagaagcagtcttccttccatagactgaagtagtctttgggaaggaaaaatctgttcctcctgctattctttgtcagtaactggcatcaacatctagccagataccctggcaacccttcacccttcagctcccatgttcttccttccaccagtcaccaagccctgtggatccacccctggagcatttatcctttcagttcttgctcttgtcatctctctccagcagcttttccccctcctccttagcggtctcccaaccacctcccatccaagtccatctacagaagcaccaaaggaaccttctaaaacagtttagattgtggctagccagtctttaaagacttctgatggttccatttcatctatcaggttaagtctaaactccaacagcaaacaagacccttcaccactgggtctcatttctccagtttcacctctcaccactcttccacacacgccctgtcctccagctacactggactattcccaatttctgaaaacatcatgctgtttcattcttctgtgtctgttcttaggctattccttctgcccaagccatccttctctgcccgctttctagtagaaagcattcgtttgatagccaggtgaaaggtcactttgtctatgagcccaagcaaaggtggtaacaaccgttgattatagttgacatttatggatcacttgctaggtgccaggcactgtactgtatcctctgcatcaagaacagttcctgacttggacaggcgcggtggctcatgcctgtaatcccagcactttgggaggctgaggcgggcggatcacgaggtcgggagatcgagaccatcctgactaacacggtgaaaccctgtttctactaaaaatacaaaaaattagccgggcatggtggtgggagcctatagtcccagctactcgggaggctgaggcaggagaatggcgtgaacccgggaggcagagcttgcagtgagccgagatcgcgccactgcacgcgacacagcaagactccacctaaaaaaaaacaaaaaaaaaacaaaaaaaaaaaaacaaaaaaaacagttcctgactcaaaaaggtcctcaggaaacatcacaacagccctgtgaaagctctatttctgcttcttagaacagctttactgagataaaaaccacacattctacccattttacaggtcaagaaatcaagacagaaacagaaagcttcagtaatgtgaccaaaaccacatagctgactccggtacccactcttaatccctgtgttaataagcctaatactgatgctatcttataataatctgcatatgtttctctctctccccatttctctgtgagtttctcaagggcaacacatttatcttaactttggctctccagcacctagtacagttcctggcacatgtgataaatgaacaaatgaagaaatgaatgaatgaatatcattcagcaatacatatgaaatcctttttaaaaatatgagaatattaaaggaaaccaatgttcttgaggaagaaaaacttatgaagtgtaatacacagagtcatgaacacaggcaaagcacaaaataaatctaactcaaataaagcagagcctgaagaatagtggttgagggtttgttgtggcagagggctggcacagagaatgctctctgtggagtaaactattgcatggctgaggcctgcagtctgggggcagaaacacagtgctgcaacagtcagtaggttggtgtgtgggaagtctgagtgtgggatgctgggacaggtgtggacagggcggacgcacagccggagcaaaagtgagggtgagtatggaggcaggcaggagactcagaaagggctatgtgttttgaaaaaagcttgaaggggtaaaaaggagttaggaaggcagaggaggaatgatatgtgcttggggcagagtcagagaagatcaaggaaagtgagaagtgacttcaaatattttaaacaaactgtgcaataagcaaacatttctggagtttgctctatacgaagagtgtgatgggtgccaggaaacctggtgactcagatagtctctgtcctcagggagctcccagtaaacaattacaaaatacaggaggaaagtacaaaggaagcagacctagcccatcaggggaagctgacacctgagttttgaacaatgagtaggtgaggctgggcagtccaaggctgtgcacaggttggagggcaagagagaatggtgtgctggggtggggctgtgtgtactgtaattagctcaatatagccaaaacagggcaagagctgggaggagtgacaggaaagagaacacaaaaggggctcccgtggatgctggtaccactcttccttaatctgggtgctggttactcaacgtttcgtgaaaattcacgtatctgtacactaatgagttatacatttttccgtatatatgtcatacttcaataaaaagttacaatccggctgggcgtggtggctcacccctgtaatctcagcactttgggaggccgaggagggtggatcacaaggtcaggagttcgagaccagcctggccaatatggtgaagccccatctctactaaaaatacaaaaattagccggatgtggtggcgggcgcatgtagtcccagctattcgggaggctgaggcaggagaatctcttgaacctgagaggtggaggttgcagtgagccgagatcacgccactgcactccagcctgggagacacagcaagagtccgtctcaaaaaaaacaaaaacaaaaaaaaagttacaatccaaaaagtctcagcaagcaggtaggagtcagatcacggagggctaagcttgcacagtcatccaaaaacatctacctacaggcccagacaggatacctgaaatcatgtctgaaatggcagcctcatgtgggcaagagctagggcatcacgctggcctaaccagaaggaactgtgccaagaggactaagagttttaccccaaaatgatataacctaccatttgctagggcagcccagatgcacaggcactaggctttctatataagccttgatatttagccttatcctagggatattagagtaaatcagtcaaatgtgtatgtacattggctgtagtatcaggaaatttcattatctactcaatctagctttgaatatgttatgttttctaactctctatttgtgtcagggtgggggccaaaagcctcagcaagaccgggggtaatactttgcctccagggactgcacctcacagcgatctgggcctgggtgggtggcacagctacaggagtgagcaggaatgtaatgaggtggggccatggggactggttcaggacagggacttcaagtggagtaatcagagaataaagagattgggtcacaggtgatgatctataccaagacaggcagaaacgcactggaatgtagtcaaaagggctcaggtcccacaggactatcagaaaaggaagttgcaccagggtgtggggcaacaagtgagactgcccaggaggaggaggagatcctgggggcagggccaatgtattacattccttgccaagtgtgttcttttaacggggcagcctctctcagagcaatccgtacatatcagtgataacgatgataatttattgagcacttactctgttccagccatgactgtaagcactttacttgccttaagccatttagtcttctcaataattccatgaagtgggtacaattactgtccccattttacagataatgaaactgaaagacagagaagttatttgtctggggtcacgaaactagtgaatgagagcaataggatttaaaccaaatggttttacttcagaccccatgttctgactgcatcactgggccaccctcttgatctcaatcaagcaccataaaaataacaataggcagagcaactagttattgagtggattctgctaaggaagcacgctaagcattttatatttcttatttattcctccactatctctaggaggtagatattctgggatcaaactgaggctcttgaggctgcatgatttgctcaaggctacagagctggtaattagaataagcaggctttgaagttgggttgacctgacaaaaactgagtccttgagtcctctatgactccttccattggcagggctttggcctacaggaacctcaactcgaagtgatgggatcaccaggcctcaggatcatcactcttccattgttcctctaaggctaggctccaggaagagaacctcattgaaacctcccaggtctccctataaggcctataaggatgctaacaatcatgaggtctcttttattttttaattttttttacatggtctcactctgttgcctagattggagctcagtgacgcggtcatagttcactacactcaaactcctgggctcgagtgatctgagggatcttttaaaagggaggatactattaaaaatagcaaccaataccatctgagcagttattacacgcctccataccattcattctttatattcactctataaggcagacactctttcatccccatgctgcagataaggaaactgaggcttagaattgttaagtgacttgcccaaggtgatagagccaggagacagtggagctgggattagccaccagatctgtctaacatgagagcagcctgggctcttaatcatgcttgaataccttctgatagcactgatccttctttctccttggcaagcaagtcctgtcacatggccttttttggtggcataaggaaagctggaagaacccttaggtggcaaacttcaagaatatctcgctgttgacaaacaccaatggtgaaaaagcaggaccatctattagcatctgtttgtctgttttcctttttaaagcctaatgaagactacttcccaaggaaggagtttttaattagctcactgaaaggcagagtacactttgcccaagcaacagccttcaaagcgaaacttaagctgctccactaaactaatatcaacctgcccaaagacctgtgttccccagccaacactacaataaggacatcacaatacaatggcccgaggcttgtcctggcctgcatctctcagagtgtcccaggcaaccctgggctgccacaaaggaagccaggggaaagcaagcagcaagagtcaaggggacaaagcaaacaaggtcactcccttctgtggtgtatctgctccatggaagtctggggagcattgctaagtttacttccactgcccctatcgtcttatcaatcaagttaatttaatttcgtttttaattatgtactcactgaagaaactttggaaaaaaaacatatgaggccgggcgtggtggctcacgcatgtaatcccagcactttgggaggccaaggcgggtggatcacctgaggtcaggagtacaagaccagcctgaccaacatggagaaaccccgtctctactaaaaatgcaaaattcggatgtggtggcgcatgcctgtaatcccagctattcgggaaactgaggcaggagaatcacctgaacccgggaggcagaggttgtggtgagccgagattgtgccattgcactccagcctggggaacaagagcaaaactccatctcaaaaaaaaaaaaaacaaaaaaaaaaaaactacatatctatacgaaaaggaaataaaactcacccatgaacttaatctacaggaacaagtattatccttttgggatctattttctaactatttttgttgctttaacatagttgagattcattaaaatgctgggcacagtggctcacacctgtaagcccagcactttggaaggctgaggcaggtggattgcttgaggcttagagttcaagactagcctggacaacagagcaagatatggtctttacaaaaaacctttaaaattccgagattgcaccactgcactccagcctggacaacagaacaagactctgtctcaaaaaaaaaaaaaaagaaagaaagaaggaaaaaaagaaagaaaaaaacccaactaggcatggtggtgcatgcctgtcgtctcagctacatgggaggatggggtgggaggatcacttgagcctaggagtgtgaagttacagtgagctatgactgtgccactgcacttcagcctgagtggcctgggtgacagagtaagaccctgtctccaaaaaacaaaattagattaaaaaaaatacatatatataatatatatatatatatacacacatacacaattttacattgtttaaaaaaacatttattttcatgtagtttaaaattatatttaaatatcatgtgcataatattctactacatgggtaaaccatattttacttaaccactcctctctaaagtattttctaatttttccagtgattataaataattctgcgattaataactttgtaccataaagctttctgtctttatttctgcattactttaggataggttctcaaaagtagaataaaaatcaaaactacaaacattttatccccaggtggatagtgttagaaaaataaatgaataaaattttttaaaactccaaacttttttttttttttttgagacggagctccgcttttgttgcccaggctggagtgcaatggcgtgatctcggctcactgcaacctccacctcccgggttcaagcgattctcctgcctcagcctcccgagtagttgggattacaggtgcccaccaccacgccctgctaatttttgtatttttagtagagacagggtctcaccatgttggccaggctagtcatgaactcctgacctcgggtgatccacctgcctcggcatcccaaagtgctgggaattacaggcgtgagccaccgcgcctggccaaaaaaactccaaacattttaagactgcccatggttgtacaaatttatcagccaacttccatgtgggagaatatctatttgatagaacatttgccagaactgagaattagcttctaaaatctttaccaatttcagaggcaaaaaacaaaaaaagctttcaaaagtttttaaatttcaatttgccttttctttattaattatccatgagttgaatatttttccataattttcagtgatttatattccttttcttgtgaattttctcaaatattttcttttttaggataaaaagtaaattattccttaattttattaaataattttattaatattatgtggtaaaatgtgaactgtagaaatataacttgcagaagttataactgaactaactatattatatatactgttagcagagattactaaaatactcaaagagctggagtggttcagagacctagctaaaatagaactcttcaaatattttaacagattagaaatgttgtttgtgagggtctctatttatagtagcaaataatggaaaacaaatgtccaacaaaagagaagcgctgggatctcataacaaatacgcaagaggaactgaagtggacatgcagcagagtgatgaaagacttcctttccaatttataggtttgaatttcttttattcttaccaaatgcttaaactacttgcaaaattaaatttaaatttaaaggaaatgacaaatatgtgaccaatgtcagacatgattcatatgaaataagtgataaaagtaaaacaaaattatgtatataacattacgaaaatgtctatgaattcattaaacaaaagtctggagtgatataaaattttttttgctctgtggaacaaaaaaaaaaccatggctgtgaaagagatacatataacttacttacatgtttttcttccccaaacaaaaaccttttcgttgacttacaggtcataaaatatttttttttaatggcatacttttacatttttacgagcgactcctaggaaaacaaataaacatgcaccttctgagggcatgtcttcagtttctctatctttgcactcggctattttaaagatgacatttccaaaggccagtacttggtcccttctgccaggctgctgcgtatattgtttattttaatggacaccagacaccttgataaatgacaacctatctgaacctgacactctggaaacagggattaaggcagggagagttcacagacagcagagtatttactgttaagagttatttctgacaaaatgaccaccacgatcttcagaacaagacaattcaggctatgcaatatctagccattttaagtaatccaataataaattaaactaataggcctacagaaagaccactcataagcattccaagagaaacaatctcttataaagacctaaggcatcctcgggtgccaccccagaaaaggtaggcaaactgtaagtaaaaggttctatgtacaactttttactctttacttcctgagtacacaaactatttaacaatagtgtacaaatataaggactcttacacgcttcttatgggagtataaatgtggcaatacattccagaaatctgactgggtgtggtggttcatgcctgtaatatcagcactcaaggaggtagaggtgggaggacagcttgagcccaggagttcaagaccagcctgggcaacacagtgagaccccattatccacaaaaaggaaaaaaaatcaataaattaattccagaaattgttaaaaagtggcaaatatttctatttctaggacattataagaaaataactaaatatgagtgcaaaaattgctgtacattagaaagttaattgtaatatttaaacagctaaaaactggaaaatcacctaaatatttaatgatacatacattggttaaagaatttctatattcataaaatgaatatgcagccattaaaaatgatagactagaactgggcgcagtggctcacacctgtaaccccagcactttgggaggccaaggcaggcagatcacttgaggtcaggagttcaagaccagcctgaccaacatggtgaaatcttgtctctgctaaaaatgcaaaaattagccgggcatggtggtgcgtgcctgtagtcccagctacttgagaagttgaggcacaagaatcacttgaacccaggaggcagaggttgcaatgaactgagatcatgtcactgcactccaacctgggcgacagagcgagactgtctcaaaaaacaagatagatcagacatttattgatatatgttatatgtagtaggttgtattattggccccaatttccccccaccatgtccaggccctttgctgtataactttgccgtgccttcctgttgtgaacaggatggaaatctccacccctgggctcagccatgtgtaacttttttttttttttttgagatggactctcgctctgtcgcccaggctggattgcagtggcacagtctcagctcactgaaacctctgcctcccaggttcaagcaattctctgcctcagcctcccaagtagctaggattacgggtgcctgtcaccacgcccagctaatttttgtatttttagtagaaatgaggtttcaccatcttggctaggctagtcttgaacttctgacctcatgacctcatgatccacccacctaagcctcccaaagtgctgggattacaggcgtgagccaccatgccgggccatatgttacattttgatcaatgggatattagcacatgtgatgcaaccaggaacttaaaaagtgcatgcctgactaggcttgctcactattgtgcttctgccattgctatgaaaagaaaatacctaagtctgtcccctggcccaagaggatgacaaccatgtggagcagagcccaacctagattagccaactccagccagccactgacgtgaaaatgaagcccatgtaaccagccaactgacaagccatgtccaacctagatcagctgactccttgctgacttacagatgtatgatctaagtaaacacttgttgttgttttaagctactgaattctggaatggtttattaacatttttgtggtactagctaattgatacaagatttaaaagtctggagggaaaaatgttggaaaaatctggaaatatataacccaaatgcttacagaggaacttttagttaaaaataatagattgatcacatgtgtttatcaactctccctccaaaaatctcattaaaatgaaaacaagagattaaaaccatattaaatcacaaagaaaataaggggagattatagcaaaaccaactttaacacaatagtgaaaaaatacaaagcaggtgagagaagaataaatcacttggtgatgtggaagaaattacagctcagtggcctacaaagaggattactaataaaaatcagccaactcaccccacagaacttctgagaaattcagcactagagtgcatcaggtgctatgggaggtgggggtatggcatagagaaaaaaatcaagttgaaagtttatatacagaccactgagaacaacaggtgttaccccaactatgtgcagccaaatgaccattcccgcataacccatccctctaactttctactctacctgcagaagacctcagttctggagaaagctaactaagggcacaagtctaggaactactttgcacagtagtgggctgaggagaggtgtgggctgaaaagcaatgagattaaataaagtctccagactgaaaccagccaccttccctgttcctgctctcacaactccagcagctagtcttatgcaccctccaccccacaaaaaaaccctaactctgctaccccagacaggacttcagaggattcctctttgggaaaactgaatagttgcaaaggaaaataaaacctgcagatgatgacatttgtaaatgcccccgacccaaagaaagaggccagcccactgcctgattccctgtacagtgaaaatgatccaccaacaagccctgcccatgcacggagtctccagtcaatatgttagtgcttcatttaaaatttttttttattattattattttttttacagatggctgtcacccaagctggagtacagtggcacaatcatagctcactgcagcctcaaactcctagactcaagcaatccttctgcctcagcctcctgagtagctgggactataggcaagtaccatcacaccgggctaaattcctttttttgtagagacgaggtctcactatgttgtccaggctggtcttgaactcctggcctcaagcaatcctcccacctcagcctcccaaaatgctgggattatgggtgtgagtcattgtgccaggccatgtctcactcttaaatagaaacagcaaggattaccatacatataagaaaatcatatggaagaaatcctcccaaaacaaacaattaaaaaaaaataccaggaagacaaagagactatgcttggaacaaatagaaactgaaaatatatatgtataatcagagatgtaataaaggatactgtggtgataaaataaaaataggatgcctcaaagaaacaaccagagaccagataaaaatgtataaaaatgtaataaataaaagttaaaactcaatagaggagctggaagataaaaacaaggaaatgtcccagaaaaagtaagagaaagtaagtaaaaatgatgggaaaaacaatagaaaataaaatatgcataacttaatcaatcaagaaaatccaacatccaataaacatccaaaacaagaggacagagaaaacagaggtagaatttggaaaagttgttcaggaacaccctctagaactaaagacactagtttccatattgaaagggcctaccaagtgctcagcataatgaatttaaaaagacgcatgtccagacatagcatcataaaatttcaaaacgctcaggataaaaagaagacacttaatttttcttctcctttttttttttttgagacagagtcttgctctgttgcccaggttggagtgcagtggcgcgatctcgactcactgcaagctccgcctcctgggttcatgccattctcctgcctcagccttctgagtagctgggactacaggtgccagccaccatgtccggctaaccatatatatatatatatatatatatatatatatatatatatatatatatatatatatatatatatttttttttttttttttttttttttttttttagtagagacggggtttcaccgtgttttcttctccttttcttgaggcagggtcttgctctgttgcccaggctacagtgcagtgtcactatcttggctcaatgtagccttaacctcctgggctcaagtgaccctcctgcctcagccacccaagtagctaggactataggcacgtgccaccacacctggctaattttgcttattttttgtaaagatgaggtctcactacgttgcccaggctggtctcaaattcctaggctcaagagatcctcctgcttcagcctcccaaagtgctaggattacaggcttgagccactgtgcctggccagaagatattaaatatttcaggaaaaaaaaactgggttatatccatgaccataaaactgctcaatagctaccaagatactagaagacaatgaagcaatgccttcaaaattctaaaggaaaagttattcgagtctaaaattcttaatcctacccaactattaatttggtgctaaaccagaacaaagatattttttagacatggaataactcaaaatatatatctcatatacccttttttttttttttgagacggagtctcactctgtcgcccatgctggagtgcagtggcacaatcttggctcactgcaacctctgcctcccaggttcaagcaattctctgcctcagcctcccaagtagctgggattacaggtgcccaccaccacgcccagctaattttttgtttttagtagagatggggtttcaccatcttgaccaggctggtcttgaactcctgacctcgtgatctacctgccttggcctcccaaagtgctgggattacaggtgtaagccactgcgcccagccttcatacaccctttcttagacaactactgagaaagtacttcagaaaaacagaaaaaaatcaataaaaaagagaaggaactccaggagaggagggatacagaacaggagatttatgaagttaagttccagtatgacagctttataccaggcccagagaacaaccaggacagactggggtaggataaaagatgtgtgagaaaaatctccagaaaaacaataaaacctataaactatttgatgtgtttaagtgttgttaaaagaaaaaaaaaaaaagaacattgttaggtacttgacagatctagtggagcaaccagggaataaaacagtgattggcacccacaaactaagcaaaaaaccaaacaagcaataaaagacaattattaaccccaggaaaaataaaaggtagtacatggaagaaaaaagtagtcatagttactactttgcccagcagtggaataacacacacagtgttgtaaaatataggtgctgatactgattcaataaaaactatgatgttgaccaggtgtggtggttcatgcttatagtcctggcactttgggaggccaaggagggtggatcgcttaagtccaggaattcgacagcagcctgggcaacatggcaaaaccctgtctctataaaaaatacaaaaattagccaggcatgatggagggtgcttgtagtcctagctacttaggaggctgaagtgggaggatcacctgagctggggaggtcaaggcttccgtgagccatgactgccactgcactctagccctgagtgacagagtgagaccccgtctcaaaaacaaaacaagaaaaaacaaaacaaataaacaagaaaccatggtgtaactactacaggaaaatcaggcaaaggggaaaaggggatattggtaccaaagagctaaatttttttttttttttgagatggagtcttgctctgtcacccaggctggaatgcagtggcgagatctcggctcactgcaacctccacctacctggctcaaaccattcccctgcctcagcctcctgagtagctgggattacaggtgcacaccaccacacccggctaatttttttcctatttttagtagcgatggggtttcaccatgttggcaagactggtcaaactcctgatctcaggcaatccaaccgccttggcctccaagtgctgggattataggagtgagccactgcacctggccccaaagagctaaatctttatcactgtccatgatgggagtgcaacaaataatgtctaaaatttataattcaggaaatataatataaggtcttatttagaaatatggaatactagcaaaagccagaaagtagttgcttcaaagaagttgaactaggggtgggaagaaagaggaaggctgctattctaatcataagccttttagaaccttttttaattttttttaagagataaggtcttactctgtcacccaggctggagtgcagtggcatgatcacagctcactgcagcctcaaacttgcaagctcaagcaatcctcctgcctcagcctcccaagtagttgggactacaggtacatgccactgtgccaggctaatttttttatgttttgcagagacaagctcttgctatgttccccaggctggtcttaatcttctgggctcaagtgatcttcctgcctcagcttcccaaagtgctgagattacaggtatgagccaccacacctggcctagaacttttttgtaaagctatgttaacagtcactgtctgagaagttaagttttcaagatgttttaatttttttctcttgccatgactacattttctaaataatcttgtattacttgtgtaatttttaaaaatgtttttaagtgttgcattaaaaaaaaaacaaaacaaaaccacagcacaagtgttgcaaaatcttgcataaatcagggactgacctttgtactctcctttcagggccttaccttttatcgtagtcaaaatgaagaaagcaatgagggtgttgttgatggcacaggtagacttggcaacacaagacaaaatcgtgtaaggatttaagagatagctggggaagaacaaacatatttggcattagtaatcctgaccaaggagccctcgccattacagcaaggaagttccaagagatttattaaaagcttacgcaaaggaaggcagcttctcagaaatgagttcccccaaataaaagagaatagagtgggggttgaggctgataagtaaaaggtactgaacatggactgcctattctgttctatggagtatatggaaaactgttgtatttaatcatcacagagatcctgtaactcacaataacatcattccagttttgcagatgaggaaacatttgcaggtgacattcaagaagcagctgagtctcaatggtaaagcgacttgcccaaaatctcacaaactaataaatacatccaaaatcaggtctttctagctctataaatgttcattttactatttcagatttcaaaaaatgataaaattctaccaattcccacagagccacatatctcaagaatagctacatttacctctgagaaccaggaaagtacattttcctcagtcaggctcctaagccctgacacaggtcatgccaatccaagagttaaagcagcttagatgtagccttcttggcagttaaacagaatccactgagccagaccccaaggacagaataagtatctactgagctcaacaagtcaagtgttacagaacttcaaaggacatctggaccctcactaggaaggagttaataagctgaaacacctagtgttttcctgagatgggaaggaatgaactgagaaaatgaattcaaaatgtttgtgagtagggaaatcttagatagtcataacaaattgtttgtatttatttctatcctgcttccacaaaggatttgaggcagctaaaatgagaacaagccgggagcagtggctcatgcctgtaatcccagcactttgggaggccgacacaggcagatcacctgaggttgggagtttgagaccagcctgaccaacatggagaaaccctgcctctactaaaaatacaaaattggccaggcgtggtggcacatgcctgtaatcccagctactcgggagcctgaggcaggagaatggcttgaacccgggaggctgaggttgcagtgaaccgagatgacgccattgcactccagcctgggcaacaagagtgaagctcagtctcaaaaaaaaaaaagaacagataataaaaaataggctgggcatggtggctcactcacacctgtaatcccagcactttgggaggccaaggtgggtggatcacttgagctcgagttcgagaccagcctagccaacatggcgagactctgtctctactaaaaaaaaaacataaaaaaacccttagccaggcatggtagtacacacctgtagtcccagatacttgggaggctgaggtgggagaatcacttcagtccaggaggtagaggctacagtgagccgtgactgtaccactgtactccagcctgggtgacagagtgagactccatctcaaaaaaacaaagaacagataataaaaaataatagcaaagtacaaatagaaataaagaatcggccaggagcaataactcatgcctgtaatcccagcactttgggaggccgaggtgggtggatcatttgaggtcaggagttcaagaccagcctggccaacatggtgaaaccccgtctctgctaaaagtacaaaaaaatatccaggcgtggtggcgggtacctgtagtcccagctactcgggaggctgaggcaggagaattgcttgaacccaggaggtagaggttgcagtgagccgagattgcaccactgcactccagcctgggcaacagagcaagactccgtctcaaataaataaataaataatcaagagcaaggaaaacataaataaaaggagacagtaaaggcaatggaaggaccaccaaatggatattctacagcactatagtaatcagctacaaattcggctctgagtttcctggcagagaaagtgaaaaggtagactagttacataattctggttatcagataggaagaaacatgccagtgtctcaggaagagatgatgattactattcacaaataaagaccttaaatccaatacctcccacgactgtgagattagcagttctacagccaaaggcctagaaattgctggcggtttttttcagcaattacagacaggcttgttacataatctttaaagaaacagctgctgctattacaaagctacccccaggacacacataagtccataagagattcataaagttgctaaatttctggttctattaaggtagatcccaccaatatttctgaaatacatagattagaactgatagtccaaaactatttggtgggaagaaaaaaaagccatttctaaatagcaggtgacgttcaagaagcagctgcatagacatctaatagggaataggaaatccacacacaaggcagaaggttgagtaaactagtctcacaaggccccttctaattctgaagttctaagggcgtgtttttccacgaggaaacttgtttgtcttgtttactgtatatccctagaaactggtatattattaatattcaatgactattagtggattgaataattattcacatttgcctatctcaggaagataaatgggaataacccaaaagagtacaacttaatggtagcactgggtacaccctagagaattctttcatagagcctcagtaagttccagtcttccacatgggtcacccagctggaatgcatctgtttggcacttcagttttataagctacaaatggaggactatactgtacacgaaacataagagctgcttgaaatggcagccacataaaaaccaaacttttattcaatccatacatcacaattgaagaactttagaaacactggttataagtaggctggaacccagatcagcatggagtcaaaaagcatttgtgaagggtttgattgtacacagccctgtgtgagtctttgtcccaagagagacagaatggctctgtctcttttgctggccagaacaacagagcccagttgtgcaacagaactacagcaaatacttgatgactaagattgcaaatctccaaaaatacaacaaacaacatgggaaagtctcatcagattttcctcgcatttgttggcactaagcctgttttgtcagggaatacttacaacagggccactttcaaagggatgtaacgcatttccataggggtccggatgagttcggccacatctggggcatactggtccagttctaggaggagtttctgctttttaaactagaaaaaaaaaaaaaaggaaaagataaaacacatgaaacaattcacttcccattgtttttatgctgaagacaaaagtcctttccatggcccacatggccctgcctggtctggccctacctctccaggctcatctcacactcggccctccccatcccctttctgggttccagcaccatgaacatgctgtgtccctccttttcccacacctttgcatttgacctggaataatttcttcttctctttccctagttaactcccacatggtccttatatctcagttaaatcatcatttccttaggaaggcacactttccctcaccaccccacacccaggtaaaatccccctgttatatatgttctttcacatatgttcacagttagtaactttttcacttatttatatgattgactaatgtctgtctccctcattagactaagagttccatgagggcagggaccatgtttatttgcttaccatgtatgcctaacacctggcacagtggacaaacaataaatatctgttgaatggctaaatgaatgacttgctggcaaagcaaagttcatagccatttgaagagttatcatcagtggcctaaagactccaaagttccatccatgaagaagtattgtcaagcaaggtagaatgatcccaaatgtcacaggatcttgggttatgttttacttccacagaggaggcgtagaatggccatgatgatcaagaggaggaaagctgggtgtgggtgggcagctggatagttaatagggagtgggatgggggtggaaagctcttgccttccgctggtgtgtcctaacaagttcatgggtgtgttccagagtgaaagaaaggtaggcaatcttataagcaaacatgggtcagaatatagatgagaaagcctctcaaaccaaaatcggtggccctgttgatttaatgatcaaagaatctcatttagacaatataaaatcaatgctgctatctattagaaaacagtatttcagaggagccaagatagctgtgcttaactgtgaaggattaaaaatttaatgatgtaaaaagcagatcacactagaaaatatactgcattgtgacatttatatgaagttaaaagcatgtaaaataatactatgtgttgggggccaggcatggtggctcatgcctgtaatcccagcactttgggaggccgaggcaggcagatcacaaggtcaggagatcgagaccatcctggctaacatggtgaaaccccgtctctactaaaaatacaaaaaactagctgggcatggtggcgggcacctgtagtcccagctactcgggaggctgaggcaggagaatggcgtgaacccgggaggcggagcttgcagtgagccgagattataccaccgcactccagcctgggcgacagagcaagactccgtctcaaaaaaaataaaaaataatactatgtgttatttagtaacatatataataaaagtcaaggccatgtgtgtggatgataaccactagattcagaacagtggtactgggtaggaggagaaatagggagatgaaagtatgagagagagagagagagctgtaggagtaaatttttttcagcccgaaaataggttcaaaagtatgtactatgctttatctatttttgcatgtcttaggtctttcaaaattaaaaaaaaattaaccaaaaaatatttttagaagaccatctttcagtttaaacttgcacaggtttaggtagaggcttaatctgaaaacctgcaacaaacttcaaaaacctccctttgatcatctctgttcttctcacagttggcagagtccaagttaagcggtgggaattatcagtaagatttatggtgccattcacagctggggttgtttaattaaaaggacaaaatataaaccaaggtgcttttatcacagagaagggggctggctcagcaatcaagtgcttagtgaggacagctgcagcagtggtagcaggaaggaggcctcactagctaagaggtctagagttctgcagcaaaaacaaggccacctggagtgggtgagatccacaaagaaggctgtgagaaaggaatagagttcatccaggggcagccagacagacaggtgggaatgcagacctcattccccaggctggaagccagccagcagggctgcactgagagaaagtggcaactacccgggatgtgtacatcctgggcaaaggtgacactgtgccagcaatggaagtacttccttataaccacaatcttctcaaatactttaaaacagaaagatcttctgaaaggagtctccaggtgggaaggcacacagatcagcaatccccacattctcagctttctagtctccctcaatttcagcagcacaggcactattatggctctcctcataggcccaatatcagctctcctaagtgtagacaaaatcccttttaaaaatccctattgcatccagctagagacaggaaagtggctaaaatcaatggaaatttttaaaattatacacacatgtgcgcacgcgcacacacacacacacacacacacacacacacacacaccccttaagaaaatataagtataaaatgaagttagggtatatattaaaatctgatgatcaatatttctagatacattcattagtcttgacaatgataagatttaaaacaatgacaggagagattaaaagtgatgtgaagggtagtgacctggatatcttacctttgtgatcactaatcagcttgtagacagatggtatgcttttccatatgtaagttatattaaaaaatcaaaatgttttaatttttaaaaatctccagggtagagtcttcctttccttccacccactcctctatacagccctttccttgtcccttgaaagataggttttgccaggacataattcccctacttcaaataaagggctttattttcttggagacagagtcttgctctgtcaccaggatggagtgcagtgttgcgatctcagctcaatgcaacctccgcctcccgggttcaagtgattctcttgcctcagcctcccaagtagctgggattacaggcgcccaccaccgcgcccggctaatttttatatttttagtagagacgggctttcaccacgttgaaactcctgaccaggctggagtttcaccaggctggtcttgaactcctgacctcgtgatctgcctgcctcagcctcccaaagtgttgggattacaggcgtgagccacagcgcccggctataaagggctttttctaatcattgaagctgcatctacgttcatttgcatccccaaaaactatggtggggtcggggagaggaaacactccacccctgtccctactcctctccaactgttagcctcagcacattccaaattcaggagcctagcctccaaatttacaaccctctaatcatattaaggggacacaggtttttatcatccattatcaaaccacctgcagctctcttaacataaattctgagttccaaacaagaagcaccatctcagcaaaggacagactagactaacattgtttttgtcaagtgagatagatgtaaaatgtcatgataaccaactggtcaccatcagcattcagtccgcaggctaacagctggagagggggtgggggtgcagtcccctctctgccctatagttctcccagatgcatctgtgtgtagacatagtttcattaccaaggataaaaagactcaaatcccaccaagatttaaatacttcccagactatgcgatatgaacccttctgacaaagggaagaagatttagaggaagacatgctgctatcctacctaaatcaacagtagtatgttagtatcatcaaaatctgccatttaaaatgagttaatttttgacagagcatacataaaacttctattctgatgaagaaacctaatgttctaatagtctgaactctaaaagtggaaaaacaaaaacattccaaattttacttcagtcttggtaataacagaatgtcttggtgcactaaaaaccagggtattgacaacaccgtttggctttctctctccctctttaaatcatgcaaagaaaaaaacccaaaaatctctatatatttccaaataaactcagcaataacaaacaaattattggtgctctaaattaaaggcatctctcctgttgacattgaagcctgactttgttaggcaattaactgaaacctagtttcattgcttcctcataaactaaccctaccattaaaaactgttttgttttgagacagtgtttcactctgtcactcaggcgggagtgcagtggcatgaccacagctcactgcagccttgacctcccatgctcaagccatccacctgtctcagtctccagagtagctgggcctacaggcacataccaccactcctggctaattttttaaagaattttttgtagagacagggtcccactatattgcccaggctggtcttaagcaaaaaattgttttaactagggagtgtgagaggttttttgatgagaattgagcaggaaaaaaaaaatacatatggcattagcatctaatcaactttcattaaaacacagttcagttttacattttggttataaagatctgggtaattgtggtcttagatgaaagctaccaatcctgcctcagctattcatatctatatcacacatatatatatctcatatatatatatatatatatatatgcacacacacatatctcatatatatatatatatatatgcacacacacaagtttattttttccctagtcttttttttttttttttttttggagattcactttcaaaaagtttcactctgttgcccaggctggagtacagtggcgcgatcttggctcactccaatctccaccacctgggttcaattgattcttatgcctcagcctcccaagtaggtgggattacaggtgcacaccatcacacttggctaatttttgtattattggtagagactgtctacctacccaacctatttcggagaagagaacagtcactgctaatttatatctgaattcctcagcttatgaaacccatgcccaattatttcatctacggccctcaagagaatcctgttaaagcatttcatctcagcccctaaagttttcaagatatgctccattagtttaagatatatactccctggtcttggtgatactaagtccctaaaatatagttcttaattttagaggaagagtcaaagaccacacaccaataacagctatgaactcttggaaacaatgatatacacacacacacatataattctccataccatttccacagttttataggcccattaaggccaagttaagaaccctcagtctagatattttttaaaatctctctggggtctaaaattctagaattcaccagcttcatctgtcactgatgaccagtgacacagaaagcacactgctatttctggtttcattagtaacaaaagctaaaatgaaccacaaacagacaatgccaatgagatgcagccttatttcaccccagcctaaatcttctctctcagtggctcccagccaatcaaggagtgttgtagccatttaactacatgggtagtacacatggttaatctgttaactttctcagaccccaggaaaagaagaatggtcccactatgcaattctccttggctattacatatggattaagactgaagtttatatcaggcatttaatacatgtcaaattttccaattaagattactttctgcagggagacagaaatgacattgagaatccaattttacctcagataggcataacagtgacttaaaagctgtatttatcttcctatgcaaaaaaaaaaaaaaaaaaaaaagactggtgaaagactagaagatttttaagggtcctcattaacgacaggtaatataactgttattcagcactactccagaagtctgaacttgcacaggtatgtggatattaatagttattaataagctacatagatgaagctggcccttctttatctgttagtaaagctgtcttgtgggtttggggttgatcattccagagctggctgaacaggccagaagtttcaccatcacttcctagcactttaaagcatctggatccttaagtataagatctttgtaataacaaagaccagaaggttaccaaattccaccagctttgctccacccacaaactacttaccacaactttattgaagtcctggattgcaaaatacagggcaatagcagtgagtgcatcagttatctgtcaaaagaaagagaaataataggaaatggaacacagtaagtgtaagagtactagagtgctaccagggcttggagttttgagatagtgatggactaccaagtactggactcttacaatcaggtagaacttcaaccctcactttgactacccaaagataaggcccattcaggcagggtgaactggaaatccctgaggatcaggacccatctaggttcacttcagtttagtggcccatatctgctctagaattgcaagatacttatgttttttgtaaaatggaaataatacccactgctttgcatgcctgatgtatgtcaagtgcctagcacacagtaggtcctcaataaatagagtttgttataattactaaggaagacctcagtgggcttcctgggtatttcttgactcaaattttcaatcccagacaagtgtttcaaattgctatgctctcaaaacatagacctgtcatcccaattctgaagcttctcgcccctgaaagcctcaaacctgtgtcctcttcttccataatgactcacagaatctcttggcaaaatgcttaggacaaattcagaatgccctccacgccggcttcacaattaaagccaatcatagaatctcagagctagaaaattcaagactatatatagtccagaaaccaaattctaaaaagagtaagtatttggaactggttacacatcagaaactattcctcacacttccataatactgccacagttccatgaattcaaagtaaagacataagtttttgcttttattttctgagaaactcctgagttcctatgttttttgttttttgtttttttcttaaacacaagatgacaagccgggcactgtgtcatgtgtccatagtcccagcagctgaggaggctgaaatgggaggaccacttaagtccaggagtccaagaccagcctgggcaacacagtgagaccccatctcaaaaaaaaaaaaaaaagagagagagagacaataaaccataaaatttaaaaatatatacatatcaattttatatggaaggttacttaccataaacaccaattcagcatagtcaattaggaaatgaaagaggtatattattaatggagtctgcagaaaaaaaacagacatgtaaaaaaaattaagttaaaccttactattatcagtttccagagtagagagtggggagaaaactattatgtcagcaaactattatgctagtattctccttcctggaatactgttctacgccagctggccggtgtgcttataggggagaataatttagtactgccggaccattttgtgctgctgggactatctgttgaattgagtaaaggaaataaaatctgatgtgttaaataaccattaaagaatagtcaacacactggccaggtgcggtggctcacgcctgtaatcccagcactttgggaggctgaggcaggcagatcaccaggtcaggagatggagaccatcctggctaacacggtaaaacccccgtctctactaaaaatacaaaaaaattagccgggcgtggtggcgggcgcctgtagtcccaactactagggaggctgaggcagaagaatggcgtgaacccaggaggcagagcttgtagtgagccgagatcacgcgactgcactccagcgtgggcaacagagcgagactctgtctcaaaaaaaataaataaataaataaaaaatatatagtcaagacactaaaggtaagaggtgaattgtagttctaagacatatataatagccgaggggaattccacaacagaccaagattgctgattccatttcactcacaaaatgagcttcttctgttctctgataagtttgtataatatttttttctttatttattttcttgagactagttcagaaagattaatgttatttcttcctcaaagatttgggaaaattcactcactgtgaagccatctctgcctggattttctttgagagattttaaatcacagattctatttatttcatagataaaacattcagatttgctgtttttactttgtcaatttaggtaagttgtgtttttccaggaatttgtccatttcatctaaattttcaagcttactgacaaaattgttcatagtatttcattttttattgtttaaagcaataaagtttcctatgagtatggctttagctgtatcacacgagttttgatacgttggatttttttgagatggagtctcgctctgtcacccaggctggagtgcagtggtacgatcttggctcagagcaacctccgcctcctgggttcaagtgattctcctgcctcagcctcccaagtagctgggattacaggcgcctgccaccacgcccagctaatttttgtatttttagtagagactgggtttcaccatgttggccaggctggtctggaactcctaacctcaagtgatccacctggctcagactcccgaactgctggcattacaggcaggagccactgtgcccagccattttcttcaatatcatttagttgaaaatatattctaacttccagtaacatttcttctttgagactactttaaaatgtaccatgttcaatttccaaatacttaggagttttcttttcttttcttttttttttgagacagactctcgcactgttgccagggctggtgtgcagtggctggatctcgcttgctgcaagatcctccacctccagggttcagatgattctcctgcctcagcctccccagtagctaggattacaggtgcctgccaccacacccagctaattttttttgttatttatatatttattttgaggcagagtttcgctcttgttgctcatgctggagtgcaatggcacgatctcagctcatcgcaacctccgcctcccgggttcaagcgattctcctgcctcagccaccacgctgggctaattttgtatttttagtagagatggggtttctccatgttggtcaggctagtcttgaactctcaacctcaggtgatccacccacctcggcctcccaaagtgctgagattacaagtgtgagccaccgtgcccggccgttttttgtttgtttgagacagagtcttgctctgttgctagagtgcagtggcacaatctcggctcactgtaacctccacctcccgggttcaagcgattctcctgcctcagcctcccaagtagctgggattacagccgcgcgccaccacacctggctaatttttgtatttttagtacagacggggtttcaccatctcggccaggctggtctcaaactcctgactttgtgatccacccgcctcggcctcccaaagtgctgggattacaagcgtgagccaccatgcccggcctaatttttttttgtattttttgtattttttgtatttttagtttcactatgttggccaggctggtctcgatctcctgacctcatgatctgcctgcctcggcctcccattctttttatatttttataatttctttctggcttaactctactgtggtaatagaaaatacactatatgactgcaatcatttaaaatgtgttgtgacttgcttaacggtccattatatggtcaactttggtaagtgctgcaggtacattcaaatatgcatattaacacctatggttgcatcattctatatatgacatgtaggctcagtttgctaatgatttgttcaaatcttctacatccttattgatttttttggtctgtttgttctttcactgactgaaagaggtatgttaaaaatctcccagtcaggcacagtggctcatgcctataatctcagcactttgtggggctgaggtgggaggatcacttaagcctaggcatttgagaacagcctggacaacatagtggaaccctgcctctacaaaatatttaaaaaattagctgggtgaggtagcatgcacctgtaatccaagctacttgggaggctgagttgggagaattgcttgagcccagggagattgaggctgcagtgagccttgtttgtaccaccgcactccagcctgggcaacaaagtgagaccctgtctcaaaaaaaaaaaaaaaaaaaaaatcccccactgtgactgccatttttgctttatatattttggagctatgtaattagatgcagttctatgtagaattactatatcttctgggtgcagtgatctttttatcattataaaataatcctcttcatctctagtaaggtttcttgtcttaaaatattcttgatctgatagtatagttacatcagcctctttgggctgtcagcataatacagttttttctgtcattttactttccacctttctgtgtccttatatgcaaaattttttgtttttgtttttggggttttttcctgaaacaaagtctcactctgtcggccaggcaggagtgcagtggcacgatcatgactcactgaagccttgacctcccagactcaggtgacccccctaccttaccctcctgagtaggtgagactacagatgtgcgccaccacacccagataatttttgtattttttgtagagacagagttttgccatgttgcccaagctggtcttgaactcctgggctcaagcaatccgcctgcctcagcctctcaaagtgttaggattacaggcatgagccactgcacctgacctaagatgtgactgattgattgactgattgactgatttagagatggagtctcactctgtccccaggctggagtgcagtggcgcgatctcagctcactgcaacctccgcctcctgggttcaagtaattctcctgcctcagcctcccgagtagctgggactacaggcacgtgccaccacacccagctaattttttatatttttagtagagatggggtttcactgtcttagccaggatggtctcaaactcctgacctcgtgatccgcccgccttggcctcccgaagtgctgggattacaggtgtgagccaccacgcccggtctgttttattttgaacttatgttcaaaattacatatgtttttctttgaccttctcctacttgggtttatagagcttcctgaataaaaatcttagtaaatgttgaaaaaaatttcatccataatctcctcaaatactgattctgcctcgttctgtctcttctcccattctagaactccactgatgtataatttgggctgttttactaagtttcagatctcttactttttttttttttttctgtgttttctatccttttctctccaagtttgaatctaggtattttcaacagactttatcttccatattactaatcttctctttagctttgtgtaatctgctgctaaattcatctatacatttttttttttttttgagacggagtctcgctctgtcacccaggttgaagtgcagtggcgtgatctcggctcactgcaacttccgcctcccaggttcaagtgcccaggttcaagcgattctcccacctcagcctcccgagtagctgggattacaggcgtatgccaccacgcctgcctaatttttatatttttagtagaaacagggtttcaccatgttggctaggctggtcttgaactcctgaccttaagtgatctgcccaccttggcctcccaaagtgttggtattacaggcatgagccactgtgcccggtccatctattacattcttttttttttttttttttgagacggagtctcactctgtcacccaggctggagtgcagtggcgcgatctcggctcactgcaagctccgcctcccaggttcacgccattctcctgcctcagcctcccaagtagcagggactacaggcgcccgccaccatgcctggctacttttttgtatttttggtagagacagggtttcaccgtgttggccaggatggtctcaatctcttgacctcgtgatccgcccgcctcggcctcccaaagtgctgggattacaggcatgagccaccgtgcctggccttacatttttaatttattatgttttctatttctagaatttccgtttgattcattttttacataccctggtgaaattattctgttatttatttcttgaacatattaatcattgatcatagctatttttcttttttgggaggggggaaagggtctcactttgtcacccaggctggagggcaacggcacaatctcagctcactgcaacctccaactcctgggctcaagcgatccttccacctcagcctcccaagtagctggaactacaggcacacaccaccacacccagctagtttttgtatttttggtagatacagggtttcaccatgttggccaggctggttgaattcctggcctcaagtgatctgcccatcttggccttccaaagtgctgggattacaagcgtgagccactgcatccggctgatcacagctattttaaagtccaagtagtttgataacttcaatatctaaatcacctgtaaatctgtttttattgtctatttttttctgtctcttattatgcttggtaatttttttccttttctttttttctctttttttttttttttttttttttttttttttgagaaggagtctcattctgtcatccagtcgggaatgcggtggcgtgatcttggctcactgcaacctctgtctcccaggatcaagtgattctcctgcctcagcctcccgagtagctgggactacaggcatgcaccaccatgcctggctaatttttgtatttttagtagagacagcgtttcactatgttgcttaggttggttttgaactcctgacctcaggtgatccgccagcctcggcctcccaaagtgctgggattacagatgtgagccaccatgcccagccaatggttggtaattttttattgaatgacagacattgtgtatgacaaactacagcagcttggatgaaggtattttcttctggaaaagatttctttaagctggtaattacaatatagttgtttcactttagggattgagctaatttgaagctggatttagtctttgtaaaactagtctatattggtctacccttactcctagagtgtagtccttcagaagttccagcctaaaggcaagtcctttaccagagccttgtcattttggttggtcctgcactccaatttgtatttccccagcaccctgagactgccaatagctctgcttagcttcttggtctctagccagccaatttctgttctgcttctccacctgtgtcacttacaaattggtaaatgcttcaaggacaaagcagctcagactgttcgtattactttttgtactttcccctctgggatcttaatccctggagtcctgcttatcttggtactttccaatgccttccagcagatgtggttttttttttccttttttcatattcatcctgcttttctagttgttcgtggcaggtaggttggtctgctactgcaagcccgttcaccaatccaccagaaccagaagggaagtgcatgacctggttttagcgagcccatgctgatgactgaggagcacctcttcccatcactaaaccatatgcatgaatgtgtcctataacattgagaggttattgacagactttttagtgagaacaagttagcatggtagcaagaacaaagactttggagtcagattcgcatttaaatccaggttccagacagctccggtggctcacacctgcaatcacaacactttaggaggccgaggtgggaggatcacttgaggccaggaggttgagaccatcccgggcaacaaagtgagaccccccccatctctacaaaaaaaaaattagctgggcatgggtagcatctgtagtcccagctatttggtttgtttttattttcgttttttgagtcatgattttactctgttgcctaggctggggtgcagaggtataatcatggctcactgcagcttagaccttccaggatcaagcgatcctcctacctcagcctcctgagtaactacaactacaggcacataccaccacaaccagctaatttatttttccccctggggggagaaacagagtctcactatgttgcccaggctggtcttaaactcctaggctcaagcaatactcccaccttggcctcccaaagtgctaggattacagacatgagccaccgtgcctggcctcagtttgacaaattttgacctatgtatacatccataaaaccattacagtcaagaaagtgaacatatccatcattcccaagtttatcaattttaatgctcatcccaaggaaccatctttgtttcagtgattttcactattagttttgttttctaccctttgtttctactcagatctttattatttcttttaatctgcttactttgagtataattttatcttttcctagtttcttaaggtagaagctgtggttattgacttgaggtcttcttttctaatataagcatttggtgctataagtctctccctaagaactacttagtgacatcccacatattttgatgggttgtgtttcattttcattcatttcaaaatactttctaatttcctttctgatttcttctttgatccatgggttaattaagaatatgttactcagtttctaaatatttggggattctctagatatctttctggtattttttatttaattcaattgtggtcagagaatatattttgtataacttgaatccttctaaacttactgagccttgttttatagaccagaatgtggtctatcttgcaaatgttccgtgtacatttgaaaaaaattatgtgttttgctgttgttggatggagtgttctataaatgacaactaggtcaagttgggttttttttttttttttgagatgaagtctaggtttgtcgcccaggttggagtgcagtggcactatctccgctcactgcaagctccgcctcccaggttcaagccattctcctgcctcagcctcccaagtagctgggattacaggtgcacaacaccacacccagctaatttttctatttttagcagagacggggtttcaccatgttggtcaggctggtctcaaactcctggcctcaatctacccgccttggcctcccaaagtgctgggattacaggcgtgagccaccatgtctgacccaagttggttgttattcaagtcttttatatctttgctgattttatgtctgcttgttctaccaatcattgagaaagggatattgaaatctctgtaattgtggatctatttctccttgtagttctatcagtcttcatatattttgaagctctgtaatttgatacataagcatttagtatcgctatctcttttatcattatgaaatgtattttatctctggtgatacccttggctctgaaatttgtttcttttttttactaacttattgtctgtttctctcagaagtataagcaccatgaagccaggcactgtgtcttgttttgtatccctaacacctagcagagtagctggcacttagtgaatatttaacaaatctttactaaaggaaggacagaagggagggaaggattgtaatgcatatgctgatagaggtaggcactaggaataagtgataagaaggggacagcacctgttttgaagacaatatatcataatgagtaaaataaacacagaggcaatttcaagagtgtgacatgagccaggaaaaggataagcataagattctttggaagactaaggtgatgagagacacctttcttttttttttttgagacggagtctcgctctgtcacccaggctggagtgcagtggcaccatctcggctcactgcaagctccgcctcccgtgttcacgccattctcctgcctcagcctcctgagtagctgggactacagccacctgccaccatgccttgctaattttttgtatttttagtagagacggggtttcgccatattggccaggctggtctcgaactcccgaccttgtgatccgcccgcctaggcttcccaaagtgctgggattacaggcgtgagccaccgtgcccggccctgtgtgcttattaagagtctcttggccgggcacggtggctcacgcctgtaatcctagcactttgggaggccgaggcaggtggatcacctgaggtcaggagttcgagagcagcctggccaaggtggcaaaaccctgtctctactaaaaattcaaaaattagccaggcgtggtggcacacgcctataactccagctacttgggatgctgaggcaggacaatcacttgaatccagggtgggggaagggggagggggttgcagaggttgcaatgagccgagttggcgccacttcactccacctgggcaaaagagcaaaactctgtctcaaaaaaaaaaaaaaaaaagtctctgaagttgttcctaacctgtttctgccagtagttcttgttattgcagtttgattagatattaacccagagataataaaattgaaatgcaaaagacagctgttatttctatgaggaccaagttgaatgcttttgaaagattagacagaagagccaaaaaacaaacaaaaaaaaactgttctcaaagtacatatgagagagataactataaaaattaaggccagccaggaacggtgactcacagctgtaatcccagcactttgggaggccgaggcaggcggatcacaaggtcaggagttcgagaccagcctggccaatatggtgaaaccccgtctccactaaaaatacaaaaattagccaggcatggtggcgcgtgcctgtggtcccagcttctcgggaggctgaggcagaggagtcgcttgaacccgggaggcagaggttgcagtgagctgagattgcaccattgcactccatcctgggcgacagagcgagactctgtctcaaaaaaaaaaaaaaaattaaggccaagcacagtggctcatgcctgtaatcccaacactttcggaggccaaggcaggaggattacttgagtgcaggagttcaagaccagcctgggcaacatagcaagaccccatctctacaaagaaatttttaaaaattagccagctgtggtggtacatgtctgtagtcctagctactcaggaggctgaggtgggaggactgcttgagcccaggaggttgaggctatagtaagccatgatcattccaccacattccagcctcggtgacagagcaagaccctgtctttaaaaaaaaaaaattagaaggtacattgtcaaattagaaaacttctttaaaatgatatggccaataagaacggaaagggcagtgggacgcggtggctcacgcctgtaatcccagcactttgggaggccaaggcaggcggatcacgaagtcaggagtttgagagcatcctggctaatatgatgaaaccccgtctctactaaaaacacaaaaaaaaattagccaggcatagtcacgggcacctgtggtcccagctactccggaggctgaggcaggagaatggcgtgaacccaggaggcagagcttgcagtgagccaagatcgtgccactgcattccagcctgggtgacagagcaagactctgtctcaaaaaaataaaaaagaatggaaagggcagtggaaagaaatgtgatggatgtggtgaggagggtcttcagggctttgtatgcccctctaaggtatctggattttatcctgaggtgaatggtgaacattcaaaggtgccgagcaagacggtgacagaaacagattcacattttagaaagatggctctgactacagaatacagtgaatgagcaagactgaatgcaaaaagacctgtcaggaagctgttgctgtaaacaagagataatctggacctaattaagagtgttttcactattctttttttttttttttttttttttgagatggagtctcgccctgtggcccaggctggagtgcaatggtgcagtctcggctcactgcaaactctgcctcccgggttcaaacaattgtcctgcctcagcctcccaagtagctgggattacaggcacctgccaccatgcccagctattttttgtatgtttagtagagctgggggtttaccacgttggccaggctggtcttgaactcctgacctcgtgatccacttgcgttggcctcccaaagtgctgggattacaggtgtaagccaccgcgcctggcctgtttataattttttttttttttttttttgagacggagtctcgctctgtcacccaggctggagtgcagtggtgcgatctcggctcactgcaagctccacctcccgggttcgcgccattctcctgcctcagcctcccgagtagctgggactacaggcgcccactaccgcgcccagctaatcttttgtattttcagtagagacggggtttcaccgtgttagccaggatggtttcgatttcctgacctcgtgatccgcccacttcggcctcccaaagtgctgggattacaggtatgagccactgcacccggcctgtttttactattcttaagagctaattttaaataaaaattagctgggcatggtggtgcacacttgtggtccctactaaggaggctcaagtaggaggatcgcttgagcccaggaggtcaaggctgcagtgaaccgtgattgtgtcactgcactctagcctgggtgacagaataagaccctgccaaaaaaaaaaaaaaaagctaattttatgggttaagtaagtttttctgggctttctaaggaaacaacattactgccgtagttttcatgggaaatcatattccaaacaacaaattacatgctaattagcatacaacctatttgcggactaaggactgtttgcaacttatttgcctttacaaatggtaacttctacagaagcctcatctgcttccccagttacaatcttaatctggatcatttccattgcaattgcaaaacctctttcttatgcagaggacatctaaaaacgggctgtttctaaatatgatcgtcaagaatacatctttttaaatgtttgtacaaaacagaggttaggctttggtatctgtgactgtaaactactcttggtacccagaaaagaaaataagaacacttacttcatgaaatactgctccagaatacggagatactcccaagtccaacagtgaaaggccttcaaccactgaaaaattagatatacaagttcactcagactaagcaggcagctacagaccaaattgttagatacccccacaaccaaaaagggccttagcgtttatctaaccccctttacctcatccccagcaagtggctttaagtcttgaacatttctgatgacgggaaactctctttcatggacagcatcctttttcattgtgggcagcactcattataagacagttttatgttaaactatctgcttccttttagttccttgtaactcttaccaactctcaaaaatgtctcatttatgcctaatcttccccattccaaagcacaataagataacaaattagaagctggtgagaaatgttgccatagtgtgaggaaatgggcagtcactctcatatgctgctcatttgagtgacatttgtattaacttttcgacagggcaatatgtgctttctaagtgtgtgccttctgacccagatatgatacttcttagggcagtttatcctatggaaataacctgacaagtacccaaagaggtatgttccttacactgttcagagtactgaacaattagaaataatctgaatgtccattaatgaaaatttatttcaatgaattatgacataatatatatctctatataatggaatgctttatacttaaaattatactgtgttataaataataaataacctctccctctccctctccctcaccctctccctctctctctctccacggtctccctctccctctctttccacggtctccctctccctctctttccacggtctccctctgatgccgagccgaagctggactgtactgctgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggccggtctccagctcctaaccgcgagtgatccgccaacctcggcctcccgaggtgccgggattgcagacggagtctcgttcactcagtgctcagtggtgcccaggctggagtgcagtggcgtgatctcggctcgctacaacctccacctcccagccacctgccttggcctcccaaagtgccgagattgcagcctctgcccggccgccaccccgtctgggaagtgaggagcatctctgcctggccgcccatcatctgggatgtgaggagcccctctgcctggctgcccagtctggaaagtgaggagcctctctgcccagccgccatcccatctaggaagtgaggagcgtctctgcccggccgcccatcgtctgagatgtgggcagtgcctctgccccaccgccccgtctgggatgtgaggagcgcctctgcccagccgcgaccccatctgggaggtgaggagcgtctctgcccagccgccccgtctgagaagtgaggagaccctctgcctgacaaccgccccgtctgagaagtgaggagcccctccgcccggcagccgccccgtctgagaagtgaggagcccctccgcctggcagccgccccgtctgagaagcgaggagcccctccgcccggcagccaccccgtctgggaagtgaggagcatctccgcccggcagccaccccgtccaggagggaggtgggggtcaacccccgccaggccagccgccccgtccgggagggaggcggaggggtcagccccccgcccagccagccgccccgtccgggaggtgaggggcgcctctgcccggccaccccctactgggaagtgaggagcccctctgcccggccagctgccccgtccgggagggaggtgggggggtcagccccccacccggccagccgccccgtccgggaggtgaggggcgcctctgcccggctgcccctactgggaagtgaggagcccctctgcccggccagccgccccgtccaggagggaggtgggggggtcagccccccgcccggccagccgccccgtccgggagggaggtgggggggtcagccccccgcccggccagccaccccgtccgggagggaggtgggggggtcagccccccgcccggccagccgccccgtccgggaggtgaggggcgcctctgcccggccgcccctactgggaagtgaggagcccctctgcccggccagccgcccggtccgggagggaggtgggggggtcagcccccggcccggccagccgccccgtccgggaggtgaggggcgcctctgcccggctgcccctactgggaagtgaggagcccctctgcccagccaccacccagtcttggaggtgtacccaacagctcattgagaacgggccaggatgacaatggcggttttgtggaatagaaaggggggaaaggtggggaaaagattgagaaatcggatggtggccgtgtctgtatagaaagaagtagacatgggagacttttcattttgttctgtactaagaaaaattattctgccttgggatcctgttgatctgtgaccttacccccaaccccatgctctctgaaacatgtgctgtgtccactcagggttaaatggattaagggcggtgcaagatgtgctttgttaaacagatgcttgaaggcagcatgcttgttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaagaacagctttaaaaaataaataaataataaataaataagtggaagagaaaggagagcttttccctacagagaattctaaggatcaaatgtagaaggaacaaagaaatagaaaatcaccacttggcgtactccatccatagtaataatcacaaaaggcaagaatcatcaatggatgctaaaattagtgggcaaaaatatgagaaacagaatatttgcaaggggaaaaataaaattttacatgggcggtggttcatgcctgtaatcccagcactttgggaggccaaggcaggtggatcacctgaggtcaggcgttcaagaccagcctggccaacatggcaaaaccctgtctccattaaaaatacaaaaattagccaggcatggtggcgcgcacctgtaatcccagctacttgggagagtgaggcaggagaatcgcttgaacctgggaggcggaggttgcaatgagccaagattgtgccactgcactccagcctgggcaacagagtgaaactccttctcaaaaagcaaacaaacaaaaaagcataacctcagtctaactgtgagaagacatcaggcagacccaaatggagacataaaataactggcaagtactcttaaaaatattaagcctatgtacaactactaggtatccataaaaattaaatttaaaaaattgtaaatgttaagtctgaggaagtatcccagattataagagactaaggcgacaaaacaactaagtgcaaagtggaatcacaggttggatattggactagaaatggacattagtggggcaaattgataaaattctaataaggcctgtaattagttaatagcattgtatcaatgttaattttctggtttaggtcattgcactatggtgatgtagaatgttaacattagaaaaaggtgaatgaaaggtaaacaggaactcttgtaacttttttgaaaatctaaaattattttaaaattaagagttaaaattaaaaagtacactagagatctatatttaatgaagaaaagcagcccataaaatattcttaaatgaaaagtaggtcaaaagacagcatataaaatataataggtttttttggtgatttttttaaatgactattttagcaatttctcttggcttttacttattttcctttgcaaattttctgggggttgagggggtacatgtccaggtttgttacatgggtaaattgcatgtcatagaggtttggagtgcagataatctcatcacccaggtaataagcacagtacccgacaggtagcttttccatcttcaccctcctcccaccctccaccctcaagtaggcccaggtatctactgctactttctttgtgtccatgtgtactcagtgtttagcttccacttataagtgagaatatgctgtatttggttttctgttcttgcattaatttgcttaggataatgtctccagctccatccatgttggtgcaaaggacatgagctcattctttttttttttttaatgctgcatagtgttccatggtgtatatgtacattttctttatccagtccaccactgatgggcattcaggttaattccatgtctttgctattgtgaatactgctgtgatgaacatacacatgcatgcatctttagggcagaacaatttctattcctttaggtatatacctagtaatgggattgatgggtcgaatggcagttctgttttaggatctttgagaaatcttcaaactgctttccacggtggctgaattaatttatattcccaccagtcgtgtataagtgtttccttttctccacaaccttgccagcatctattattttttgactttttaataatggtcattctgactggtatgagatagtatctcattgtggttttgagatagtatctcattgtggttttgatttgcatttctctaatgactaattatgttgagcattttttcatatgcttgttggccacatgcatgtcttcttttgagatgtgtctgttcatgtcctgtgcccccccgccaactgtttttccaagacaggttctcgctctattgcccaggttgaagtacagtggcatgatcagggctcactgcagccttgacctctcaggctcaatcgatcctcccacctcagcctctcgagcagttgggacttcaggtgtgcatcaccatgcctggctaatttttgtattttttgtagagatggggtttcaccatgttactcaggctggtctcaaactcctgggctcaagcaatcttcctgcctcagcctcccaaagtgctggaattacagtggtgctggaattacaggtatgagccaccatgcccagccctttgcctttttttttttttttttgagacagagtctcggtctgtcacccaggctggaatgcagtggcttgatcttggctcactgcaacctctgcctcctgggttcaagcaattctcctgcctcagccacccagtagctaggattacaggtgcctgccaccagaccacctaatttttgtatttttagtggagtcggggttttactatgttggccaggctagtcttgaactcctgacctcaagggatctgcctgcctcagcttttcaaaattgcacatttttaaataggtttgtttgtagagttttatcttaaacttttataagcattcatttaattatttgaaagagagagaatgaacatgtactcaatgagaaatgcctggaaaaataaatatttaaatgttcacaatgaccatttctaggtgataagattacagaagatgcttgatttttttcatcttcattttatgaatctttagcaatgaggatgtattattttacaattattcaaaagaagtagtttttgtttttgttttggagacagggtctcgctctgtcatccagactggagtacaggaattacaaacgtggctcactgcagcctcaacctcctgggcacaagcgatcatcccacctcagcctcccaagtagctgagaacacaggccaatgccactacacccagctaaatttttttttggtagagacagtgtcttgccatgttgcgcaggctggtcttgaactcctgggctcaagccatcttcccaccttgacctcccaaagtggtgggattacaggcgtgagccactgcacctagctactttttatttttgaatcatgtgactgagttacctattaaaaaataggtaggcagggattcaaggagttcaagatcagcctgggcaacataaggagaccctgtctctataaaaaaacaaaaattagctggggcatggtgatgtgtgcctgtggtcccagctacttgggaggctgaagtgggaagatcaattgagcccaggaggtcaaagctgcagcgagtcatgatcatgctactgcactccagcctgggtgacagagggaaaccctgtatcaaataaacaaaaacagaaagaaaagaaaagaaaaaagaccactacatatttgtaaggagtgggctataattatgactttaaactttataagactaccctaaagaaggtagggtagtcctataatcaattttataattcatggtggccataaaataaaacaaagcatattgctcaagaccgttgtaactggtccttatactgcaaccaaaaggaaatctcaaggagctgcataaagaggttgctgcgtaatagctattaaatccttcactaacagctttactggagacccaaggagataattcatcaggtcaaatcacaaggcatttctcaatcttagccaatggcatcctaccacagagcagtaaaaaagcaactctacagggcaccagtatgcggccgtccaggcacatcactctccacttgtctggtttaatccagatggaaatttttgagacacagcttgaggacagactgcacaacttttaggcaattgcctaaaatgtaattcatctcagatatgcttttgctagatactgtatatcagtggatttgttagtgtattctctggcaaatgcctggagtgtggctctgctatattgatgattaaatatggcatcatattacttaattgataactgatctgggcaaagggtcagactatgtaaaacatgtaaaacatttttttgtctttcttttttgagactcactctgttgcccgggccggagtgtaatggcttgatcatagctcatcgcagcctcaaccttccaggctcaagtgatcctcccaccccagcctcccaagtagctgggactataggtgcatgccaccacacccagctaatttttaaattttttttgtagaaacgggctcttgctatattgcccaggctggtaaaaacatttttaaaaaccctaccatttactacaatattaaacagttgaccgggcacagtggctcacgcctgtaatcccagcactttgggaggcccaggcgggtggatcacctgaggtcaagcactcaagaccagcctggccaacatggtgaaaccctgtctttactaaaaatacaaaaattagcctatttgggaggctaaggtagaagaatcgcttgaacctgggaggtggaggttgcagtgagacaagattgtgccattgcattccagcctgggcaacaaaagtaaaactccgtctcaaagcataaaaaataaaaaaccaacaaaaaaaagtatatggctgggcatggtggctcacgcctgtaatcccagcactttgagaggccaaggagggtatatcgcttgagctcaggaattcgagactggcctggaaacatggtgaaaccctgtctctaccaaaaatacaaaaaattagccaggcatggtggagagtgcagctactcagcaggctgaggtgggaggattacctgagcccaagagttcaaggctgcagtaagctgtgattgtgccactgcactccagcctgggcgacagagccagaccccgtctcaaaaaaagaaaaaaaaagtataggaagaacataaactcagaatattttttgtttgtttgtttttgagacagtctcacactctgtcgcccacgctagagtgcagtggcatgatcttggctcactgcaaccttcacctcccgggttcaagcaattctcctgcctcagcctcctgagtagctgggattacagatgcacaccaccatgtatggccaatttttttttttttttttttttttttttttgagactgagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcccaattttttttgtatttttagtagaggcggggttttaccatgttggccaggctgatctcacactcctgacttcatgatctgcccgcctcagcctcccaaagtgctgggattacaggcgggagccaccacgcctggcccagaatatttttaatggaatacatttagttttaatgataaacttattactatccttacttttctaattttggtgcacacgattaaaaactgtgacctggtctgcagtgcatttggaaacatctaaggtacatagatgtttcatctatgtacatctaaggcacataaaacatactggtacaagagtaccaacatcctctttaaaatagtgaatctactctccatagaaaagaataatcagggctgtcaaattctaatatatataaaaatgttccaataggctgagcattgtaatctcaatacgttgggaggccgaagtgggtggatcacctgaggtcaggagttcaagaccagcctgaccaatatggtgaaaccccgtctctactaagaatataaaaattagccaggcatggtggcatgcacttgtagtctcagctcctcgggaagctgagacaggagaactgcttgaacccagaatgcggaggttgtagtgagccaagatcgtgccactgtactccagcccgggcgatagaacaagactccatctcaaaaaaaaaagttccagtaatatcatgctgaaaacactttaaagtcagtttcacaaagtgcctattagggggaaaaaacaaaaagacaataaagatacccatagaactcaactttatgcctttctttttcctggagtatcctccaaaaataaaacctgtgaaaatacaccagagcatccaagtaacatttctcacttcatgggactattatctaacaactaatataagagctaaataattatggccaactattgtaaaatgtaagtttttttttttttgataaagactctcaactcttaactgataactaacccatgaagcaagcttatttaattaattaatttatttatttatttatttttagagacaggggccttaatcttttgcccaggctggaatgcagtggcacaatcagctcactgcagccttaacctcccgggctcaagctcagcctcccacgtagctgggactactggagtgcaccactgcacctgactaattctttttttttttttttttttttttttttgagacagagtctcgctctgtcacccaggctggagtgcagtggcgcgatctcggctcactgcaaactccacctcccgggttgacgccattctcctgcctcagcctcccgagtagctgggactccaggcgcctgccaccacgccaggctaattttttttgtatttttagtagagacgaggtttcaccgtattagccaggatggtctcgatctcctgacctcgtgatccacccgcctcggcctcccaaagtgctgggattacaggcgtgagccaccgcgcccagccagcacctgactaattcttattttttgtagagatggggtcctgctatgttgctcaggctggtctcaaactcccggcctcaagcgatctacccaccctggcctcccaaagtgctaagattacaggcatgagccactatgcctggccaataattcttagttaccttggtatacttttcctatgggtgataataaaagcatatcatcctgtataagacaaatattatttttcagtttcccgtatcaataaggacaaaagcttgttcaaaagcagtagtgtccctatacttctagctgagggcctaagaagcagcatcactccagctgcaatgaacacacctagcattcagaactttgtttctaaataacattctctaataaaaggagccagggcccttgaagaagtggtcaattccagggctgaactaagcaagataaacctggatcatcttatagttctagaatgtaataaagtgcttttaaaaaaaaaaagtgagatagaggtatggcaaaaggacaaaggggtcaagatgaaagcggtcccaatggccaaaactagaataatccaaacaacagaatgaatatagtatacagagtccagagtataaaatatccaaatctatactgacataaatagttaaataaatgcaaagaaatgacaactcttccttacagaagaattttaattattaaataaaaatgaatgagagaaacagaaaagtcaccattgaaacacctgagtaatgactgttacaggcaagattaacctatgaatgcaaaaattagtaggcaaaaatttaaaaacaggatatttgcagagctccaaagaatagcccctaaaatgctgattaattacaaagggaaacagtcactttatggtggagaaatctggcagacactacattaaccaagggattatggctgacatcaccagtattagggcatttcaatatgcacccctgatccaatgcactgagaggaccatatcatctcaggggtattcttccccaaaatccattacctccgtcaaaccacaagaaaacattagacaaaaccaaattgagggacattctacaaaatacctgaccagagctcttcaaagtgtcaaggtcataaaagatgaggaaatgctaaggaactatcacagataaacgactaaggagatataacaactaaacgcaatatgtggccaggcgcggtggctcatgcctgtaatcacagcattttgggaggtcgaggcaggtggatcacctgaggtcaggaattcgataccagcctggccagcatggtgaaaccccgtatccactaaaaatacaaagattagctggcatggtggcagggacctataatcccagctactcgggaggctaaggcaggagaatctcctgaatctgggaggtggaggttgcagtgagccgagatctcgccactgcactccagcctgggtgacagagcgagactccgtctcaaaaaaaaaaaaaaaaaaaaaaggggggggcgggcgtgctggctcacacccgtaatcccagcactttggaggctgaagtgggcaaatcatgaggtcaggagatcgaaaccatcctggctaacatggtgaaatcccatctctactaaaaatataagaaattagccaggcgaggtggcgggcacctgtagtcccagctactcgggaggctgaggcaggagaatggcatgaaaccggaaggcggagcttgcagtgaaccaagatcgtgtcactgcactccagcctgggtgacagagcgagactctgactcaaaaaaataaataaataaataaataaaataaaaataaaaatgcaatatggaatattagatcatagaacagaaaaaaaattagtgaaaaaatggtaaaactttttttttttttttttttttttttttttttttacacagggtcttgctctggtgccaggctacatacagtgcagtggcatgatcatagctcaatgcagcttcctcatcccaggctcaagcaatcctcccacttcagcttcccaagtagctgggaccacaggtgtgcgccaccaaaccagctaactcttttttaattttatgtagagagggagtctccctatgttgcccagactggtcataaattccagagctcaaggcatcccctcgcctcagcctcccaaagtgctgagattataggcatagccactgtgcccagcaaaaatggtaaaatcttaacaactatggtttagttaatagtattgtaccaatgctatcatcttagttttgatcactgtactatgactatgtaggatattaacattgggggaagctgggtgaagggtatacagatctctctgcaatatttttgcaagtattctgtaagtttaaaatgatttcaagtaaaaagctaaaaaacaggctggtgcagtgactcatgcctgtaatcccagcactttgggaggcagaggcaggtagatcacttgaggtcaggaattcaagaccagcctgaccaacatggtgaaaccctatctctaccaaaaatacaaaaattagctgggtgtggtggcacacacctgtaatcccagctactcaggaggctgaggcaagagaattgcttgaacccaggaggtggaggttgcagtaggccaagatcacaccactgcactccagcctgggcaacagagtgagactctggctgaaaaaaaaaaaaaaaagtaaaaaacaaaaaacagtggtatctagtctctggatccagctgcctatttgcaggaaatagagatgatagaggaacatgttaaattgtatcatgatatataatcaggaaaattcaaactatgggagatctgtctggattcttcaatagataaacactatggaagagaaagggaacctgggaccctaaaaattaagagagattgaaaacacaaacaaaaacttttttcttaggggcaagactaagcctaacggcaaatgaactagggatgttcatttgagtaataaaacttttaaaaatacaaagatgtcattacatataaaagtcaggataatagttacttatgaaaagagtgaggggattgtgacgaaggggggcttctgaagtgagtggcaaagttctgattcttgacttggatgacagttacaaaaatgttcaccttacaataattcaccatagaatacattgttatgtgtgtcttacaaattctgtttaattttgtaataacggctttttttttttttttgagacaaagtcttgctctattgcccaggctggagtgcagtggcatgatctcagctcactgcaacctccacctcctgagttcaagtgattctcctgcctcagcctcctgagtagctgggactacaggctcctgccaccacacccagctaatttttgtatttttagtagagacaaggtttcaccatgttgcctaggccggtctcgaactcaagctcaagcaatctacccacctcccaccttagcctcccaaagtgctgggattacaggtgtgagccacctcgcctggccataaaggcttttttaagtagtggtatcagaagtgctcttcctgaccctgattcttttatttttgagacaaggtcttgttctgtcgcccaggctggagtgcagtggtgcaatcttggctcactgcagcctccacctcctgggctcaagccaccctcccacctcagtctcccaggtagctgggactacaggcacacgccaccatacccacctaatttttgtatttcttttttgtagaggtggggtttcaccatgttatccaggctggtctcaaactcctaagctcaagtgatctgcccacctcagcctgccaaagtgctgggattacaggcttgagccaccatgcccagcaaccctgattctcatagctgtagtaggggtgggtttctagataagtactaatagcttgggctctaccctgaactcaaaaagctaagcctatacgaactgtcaatctttgggtgaaagcctcaggaaagactaaaacatggcagaaagtttctaacattattcctgacagatatctaaacaagatgatactggtggaacagccatacctaaagattgctagctcttcatacaaaatattattagcgaggtcaccttgggcaaatgacttaatctctccatgcctcaattttctcatttataaaatggggttgataacagtttgccattttagagatcaaattagtgcattaacacacctaaagtgcttagaacaataccaggcatgtaaaaagcatcatatcattgttaatttctttcttttcttcttcctttttttttgagacggagttttgctcgttgcccaggctggagtgcaatggcgcgatctcggctcaccgcaacctctgccccccgggttcaagtgattctcctgcctcaacctcccaagtagctgggattacagtcatgcaccaccacgtccggctaattttgtatttttttagtagagacagggtttctccatgtcggtcaggctagtcccgaactcctgacctcaggtgatccacccacctcggcctcccaagtgctgggattacaggcgttagccaccgtgcccagcctgttaatttcttattaattttttagaagctcctgcttttgtcaaacaggaaattcattccttaaaaatttatttcttggccgggcgcagtggctcacacctgtaatccaccactttgggaggccaaggcaggtggatcacctgagatcaggagtttgagaccagactgactaacatggtgaaaccccatctctactaaaaacacaaaattagccaggtgtggtggctcatgcctgtaatctcagctactcaggaggctaagacaggagaatgaatcgtttgaacctgagaggcagaggtttcagtgagctgagattgtgccattgcactccagccagggcaacaagagtgaaactccttctcaaaaaaaaaaaaattttctttttttataaggcagagtctcactctgtcacctaggatggaatgcagtggcacgatctcggctcactgcaccctccacctctgcctcccgggcccatgcaatcctcctgccttagcgtcccgagtagctgagactacaggtatgggccaaacatgtccagctaatttttgtatttttttgtagagacagagttttgccatgttgcccaggctggtctcaaactcctgggctcaagtgatcctcccgcctcggcctcccaaagtgctgggattacaggcatgagccacaaaacccggcctggaaatttatatgtattttagttacactatcaaataaaccgatggatttgtagaaataggtaacagaaaagatatttttcctgttgaaatggatatgttatttgtgcctgcccaacatcaatcttcccttcttttggtaacagcaccctaatttttcctatgggataccccccttgtgtacattttgggtgagactgcctcctttccaaagaggtagatacatgacccaggcagactacagtaattgaccgaagaattggtatatgacccaaatcagttcaatgtgacttaattccagagctttcgttgcacttattcaaaaaaaaagaggtcaggcatggtggctcatgcctataatcccagcactttgggaggccaaggcagaaggatcgcttgaggccaggagcttaagaccagcctaggcaatatattgagaccccatctctacaaaaaacaataaaaaacaattagcaaagtgtgggagcatgcaccaatcccagctgtttgggaggctgagtcaagaggatctcttgagcccagaaggatgaggctgcagagaattatgatcatgccgctgcactccagcctgggagacagagtgggaccctgtctctcaaaaaaaaaaaaaaaaaaaaaaaatcagtccatactatagccaatcaaaatctatttggatttggatccagggcccctttacccaaagaactgatcattcaaaaatttaaaatgtcagcccggcgtggtggctcacgcctgtcatcccagcactttggaaggccgaggcgggtggatcacgaggtcaggagatcgagaccatcctggctaacatggtgaaaccccgtctctactaaaaatacaaaaaattaaccgggtgtggtggcgggtgcctgtagtcccagctactcgggaggctgaggcaggagaatggcgtaaacccgggaggcggagcttgcagtgagctgagattgcaccactgcactccagcctgggtgacagagtgagactccgtctcaaaaaaaaaaaaaaaaaaaatgtaaaatgtcatgtgaaaccagaaggagtcctactttactatttttaaattcctgccttttagggtttatataatcagctgctttaaaaaatatcccatttaaggtaccctttgaagaaaagtaatgcttacagatgttgtaccttccctcccaaatgatacaaataatcatgctgatttagtcagatccagatgatgggtggttaacaaatctctctctctttctagtcctgacactggcctcaagctccagacctaaacctgtcagtattgtactatcacattatacacacatgaaacactactatgtcctttctgattcatctatttcagcccatgtcagcactatttttcctaatatctcaactcaaaaccttagaattcacctttttggctttcattattgtgttgagcttcaacatggattatctcgttgaacaggatacataatttcctattttacagatggaaacactgacgttagaattcatacagcttggccgggcgtggtggctcacgcctgtaatcccagcactttgggaggccaaggcgggcggatcacgaggtcaggagatcaagaccagcctggctaatatggtgaaacctcgtgtctactaaaaatacaaaaattagccaggcatggtggcatgtgcctgtagtcccagctacttgggaggctgaggcagaagaatcgcttgaacctgggaggcagaggttgcagtgagccaagatcatgccactacactccagcctgggcaacagactgagactccatctcaaaaacaacaacaacaaaaaaagcttggcgcagtggctcatgcctgtaatcccagcactttcacaggtcaaggcgggcggctcacctgaggtcaggagtttaagaccagactagccaacatggtgaaacttatctctactaaaaatacaaaaattagctgggcatggtggcgggcacctgtaatcccagctacccaagaggctgagacgagataacagcctgaacctgggaggcggaggttgcagtgagccgagatcgcgccattgcactccagcctgggcaacaagagcaaaattctgtctcaaaaaaaaaaagaattcatacagcttataagttgcagaactagagaaagagtcaaaccttttctgagattccagaccctgcactcttaattaccaaacaacactgtctcatctttggatccttcacctgtccatcctgtaagtaacctcctgtaagtaaccagatcctatgctttcttctcttccacatttattcaacagtaactacacacctactgtatgccagacataaaagaattcaggaatgaataaaacagaatccttcaaggagctcataatatagtggaaaaggccaggtgtggtagcttatgcctgtaatcccagcactttgagagacccagatgggcggatcacttgagcccaggagtttgagaccagcctaagcaacatggtgaaaccccatctctacaaaaaatacaaaaaaataataataataacaagtagggttggtggtacatgcctgtagtcccagctaccaactacttgggaggctgaggagggaggatgtcctgagcccgagaggtcaaggctgcagtgacccattatcactgcactccagcctgagtgtcagagtgagaccctgtctcttgaagaaaaaaaaaaaaaaaaagaggccaggcatggcggctcacacctgtaatcccagcactttgggaggccgaggaaggcagatcacctgaggtcgggagttcaagaccagcctgaccaacatggagaacccctgtctctactaaaaatacaaaattagccaggcatggtggtgcatgcctgtaatcccagctgcccaggaggctgaggcagaagaattgcttgaacccagggggcggaggttatggtgagccgagatcgcaccattgcactccagctagggcaatgagagtgaaactccatctcaaaaaaaaaaaaaaaaaaaaagagagagagagaaaatgtggaaaaaccggatataaacaggtaattatgagataagaaatgctcttagtagggtgtagaggaagaagggcctaatactgcctcaggttttcagttatccagaagaaaacaggaaccaaatggcttcgattcatttcaacagaaaaataatacgcagaggtaacaaatccaagctcttacaatctcagacatgaattattactatctttattaccattccccaactaggaaacctgggcaaattaacttctctaaatttcagttccctcatctgtaaaagggggaaaataacaccatctatcacatagaaataaatgtgaggactaaatgagaaaaggtatatgttaccatttttagaaaccttaactctattcataaaacacccattcattatgccgttccccataccaacattctatgggataacatcaaaacgttagccttggccaggtgccatggctcacgcctgaaatcccagcactttgggaggccaagtgagactgcttgagtccaggagttccagaccagcctgggcaacatagaaagaccctgtctctaaacaaaaaacaaaaacaaaaacaaaaaaactttagcatttaaaggacacaaaggggacttctggggtgctgatactgtttcttgaactaggtgctggctacatgagtgaatacagtttttaaaaattcattgaactctacacttacttaatatgcattgtatgtatactgtacttcagtaaaaaaaaaaaaaaaaaagttgtttgtttttttttaatcatcaaactctggcctaaacctagcttccaccccattactcccctgctttggacatttcacatccttgaacgtttcttcatcctatttactttctgctacctggaactctccttttctctaatctccctttcaaaaccctacatccttcaagagtcagctcaaatcccacattctggaaaactggaaaggtaggggatagtttattcagggtcagaatactaaggaaggaactgggtggacacataaagtatacttttcatgaattattataacgatttgtctccctcactagcctgtgcagctacttcaggccaacttcgctttctcgctgtaggcgttagtataaaacaatgttcggtgaagaacttagtaaggaacagtaacaaaaattgccctgcaagtcccagactgagaagagacgtctaaagcacacgcacactctcctcgcttaagcaaaattggtcccctcatcccggaccccctcacacataaccttttatcccagggagcacccctggcgatcccgccccaaatcccaaactcctctgcaagccgcgctccacaagcacctcctcctcttattccaacccttcccacagaccacactcctcggctcaggacactgaatgggacacgccccctcagatccccaccactaggtggtccggcccccagggcccaaacctcacgacactgtccccacgccccggtccccacgccccctcccctcaccagccccgccctcaggccccgccctctccaagaaccccacgagacagtcagttagttctctaggaaccgcgcgctggcggtcactgcccccgcctcccattcacagaggccgcgggagggcaggtggggcctgacagtctgctcgagccagtggcctcacctctcttccaagagctcagtggggacaccacctccacccgctcggaaatgaactcggccagactggagcggaacaaggccgcccgcactgtcacagccaccaccagcaccaggaccaagggagccgccatgataactggggcgggcgcgcgggcggggagggaaggcgaggcggaggagcctcgcgcgctgtgcgccacgctctgtagttccgcgggtgggcgcgcgctgccgctggcgccggagaggccagacgtggggactacggctcccagaaagccttgcggcgaggcgggccggagcgacggaaagcgggcgcctcaagctgcgtatgcagaaggtggggcgaaaccttctacgatcgcaggtgttttgtgaagccgcgccgctatagcggggctgaaacgctgctgaaagtagaagcggaagtagtcgccttcctgggattgtgagagacttttaaacagatgttaaattcactcttgcgtgtatgttttcaatgccaaaatgtttatttttatttttatttttattttttttgagacggagtctcgctctgtcgtccggctggagtgcagtggcgcgatcttggctcactgcaacttccgcctcctgggtagctgggatgacaggcgcccaccaccacgcgcggctattttttttttttttttttttttgtatttttagtagagatggggtttcaccatgttggccaggttggtctcgaactcctgacctcaggtgatccgcccgcctcggcttcccaaaatgctgggattacaggcgtgagccaccgcaccctgcccaaaatgtttatgttttttgtttttgagacagggtctcagtgccgtcgcccaggctggagtgcagtggcgcaatctcagctcactgcagcctggacctcccgggctccagagtagctgggaccacaggtgcgcgccaccacacccggctaagtttttgtacttttagtagagacggggtttcgccatgttgcccaggctggtaccttttatgtttttaaagagtgttaaatgtgtattttttaaaaaatttattctggcagttgtttgttaaacgccaactattttccaggcactatgttaggttctacagatgcgttttggagtagtagactgatttattagctagttcaacaagtcgcttaacccttgtgtgctgaaaaatgtgctgattataggctaactagggacagttgaggaaggcttagaaattttttttttgttttggaaacggagtttcgctcttattgcccgggttggagtgcaatggcgcgatctcagctcactgcaacctccgactcccaggttcaagcgattctcctgcctcagcctcccgagtagctgggattacatgcatgcgccatcacgcccggctaattttttgtaattttagtagagacagggtttctctatgttggtcaggctggtctcgaactccagacttcaggcgatccacctgcctgcctcggcctcccaaagtgctgggattacaggcttgtgtcatcgtgcctggccggaaggcttagaaattttgccagtcgcttttaaacacaggcatttttgaaaattaagacatataaacctacagttaaataacttatattgaaaacaacggaatacatattcaacacgtcactttctaattattttactacacttttttttatatgtgcttttgagattatttaccaccgctgtatcagtacagcaaatactatctctttctcttcccaaatggtggtgttcagtttcctcaggttgatagattgaaaatccctcccaatgcgagtgtttacaccacaggaatcagcaaacactacaaatcaggggtttggggtttggagagcccattgataagcattaagcagcacacttcattaattaatgtatagtaagtgcttaaatattagcaataataatattaaatgtgcaaggaaatttcatatttgtgaagaaaaggaaacaggctggacgcagtggctcacgcctgtaatcccagcactttggaaggccgaagcagccggatcacttgaggtcaggagtttgaaaccagcctgcccaacatggtgaaacctcgtctctattaaaattacaaaaattagccaggcatggtggcctgtgcctgcagtcccagctactcaggaggctgaggcaagagaatcacttgaacctgggaggcggaggctacagcgagccaagatagcgccattgcactccagcctgggcgacagagccagactctgtctcaaaaaaagaaagagagagaagaaagaaaacgaaacagtgtatgactgagaataactgctggtgtaataataagggtggtaacactagacaaggtgatcagggaagactctagaaagaggtgatatttgagctgagacctaaaggatgagaaattaatcagagcctccaagcagaaggaacggactgagtggggaaagagcaaggtatgtttgaggatcagaaagaaaacaagtatggctcaagtggagagaatagaagaagctgtggatggagagacggggggcaatcaggtagggacctattggccatgcttgagaatttgggctttattcaaagtgcaatccatatgccattggagaattttaaaccagaaatgatgtgaacaggtgtacatttttcaaacatctctatattcccacaagccctctattgggtgttggggaatattgcagtgacaaaatggcaccatctgcctttgcccttatgtaacttggaaagcagttgaagagataaaatagttaaagaataacataagtaaaatcacaaaccataactccagcctgggcgacagagcaagactccgtctcaaaaaaaaaaaaaaaaaatcacaaaccttaatgagagaaagaaaagggggagtgggccaggcgcagtggctcacgcctgtaatctcagcactttgagaggccatggcgggaggattgcttgagcccaggagtttgagaccagcctgggcaacatggtgaaacctgtctctacagaaaacataagaattacccaggcatggtggcgcatgcctgtagtctcagctactgggaaggctgaggtgggagaatcacttgagcctgggaggttgaagctgcagcgagccaagatcacgccgctgctctcaggcctgtacgacaaagcaagaccttgcctcaaaaaaaaaaaaaaagaaaaaagaaaaaaaatggccgggcgcagtggctcacacctgtaatctcagcactttgggaggccgaggcaggcagatcacttgaggtcaggagttcgagaccagcctggccaacatggtgaaaccccgtctctactaaaaatacaaaaaatttagctgggcaaggtggcgggcacctgtaatcccagctacttgggaggctgagacaggagagtcacttcgacccgaggatcggcggttgcagtgagccgagattgcaccactgcactccagcctgggcgacagagcaagactgtctcaaaaaaaaagaaaaaagaaaaagaaaaaaatgggagtgggattctaaaagaatgcaaaaataaaccctggggctgatagctttctggaccagtgaaaggggtagggtctcctttgggggaggggatcatgaagaaattagaggggcactcatcctttgagcccctgctgtgtgccaagtagtgtaccatatgcttaacacacatgagcttatttagtctgcacagccttccttcttaaagatgtgggtttttgtatccccttttacataaaaggagatatatgtgttgcatcatcttacagtgaagtgtattacatcataaaaagtggaagtaattgtaacactaacctcatagtgaatattgagcaaggttatacaatgtaaaatgcttagcacatacccagtgctcagtaaaggttacttagctgttatattatttacatcattctaacagatgacttaaaaatttatcttagggtgaggattgtctttgggaaaaacagtgattagccattgtagacagatgtgacccaaaccagtggttctcaaaatgagtgtgcatgaagtatgaatacaactagtggttctcaataaaaaaacacaagacccaaatacagaagctagaattataaaactcataaaagaaaacataggagtaaacttttatgacctttaattaggcaatggtttcttagataacaacaccaaaagcacaggcaacaaaaggagaaataagtaaattgagctttgtcaaaattaaaaacttctgtgttccaaaggacaccatcaagaaatgaaaactgctgggcacggtggctcatgtctgtaatcccagcactttgggaggccgaggtgggcagatcacttgaggtcaggagtttgagaccatcctggccaacacggtgaaaccccgcctctactaaaaatataaaagttagccaggaatggtggcgggcacctgcaatcccagctatcgggaggctgagacgggagaattgcttgaacccaggagctaatgttgcattgagccgagatggtgccactgcactccagtctgggcaccagagcaggactctgtctcaaaaaaaaaaaaaaaatttaaagactgggcgcggtggctcacgcctgtaatcccagcactttggaaggccgaggccggtggatcacaaggtcaggagttcaagaccagcctggccaagatggtgaaacccccatctctattaaaaatacaaaagttagccagtcgcagtggcaggcacccgtaatcccagctacttgggaggctgaggtgggagaatcgcttcaacctggggggtggaggttgcggtgagctgagatcatgccactgtactctagcctgggcaacagagtgagactccatctcaaagaaaaaaaaatttaaaaaagagaaatgaaaactggctcaggcctgtagtcccagcactttgggaggctgaggtgggaggattacttgagcccaggagttcaagtccagcctgagcaacatgataagacccccatctctacaaaaaattaaaaaaaaaaaagccaggcacagtggttcacacctgtaatcccaacactttgagagaccaaggtgggtggattgcttgagctcaggatttggagaccaacctgggcaacatggcgaaactccatctctatttaaaaaaaagaaaaaataaatacaaaaatgagccaggcatgatggcatgcacctgtagtcccagctactcgggaggctgaggtgggaggactgcttgagcctaggaggcggaggttgcagtgagccaagattgtgccactgtactccagcctgagcaacagagtgagaccccttcaaaaaagaaaaaagaaaacccacagaatgggagaaaattatctgcaaattatatatttgagtagggacttatccagaatgtttaaagaactgttacaactcagtaataaaaagacagtaataaaagacaaatacccaaatggagaaaggaattgaatagacatatcaccaaagaagatacacaaatggccaataagcatgtaaaaagatgctcgacattattagttattagggaaatgcatatcaaaaccacaatgcgataccatttcaaactcaataggatagctataataaaagactgacagtagaccaggcgcgatggctcatgcctgtaatcctagcacttttgggaggccaaggcgggcagttcatttgaggtcaggagttcaagaccagcctggccaacatgttgaaaccccgtctctacaaaaaatacaaaaattagctaggcatggtagcacacgcctgtaagcccagctactaaggaggctgaggcaggagaattgcttgaacccagggggcagaggtttcagtgagccgagatcacaccactgcactccagcctgggtgacagagcaagactccatctcaaaaaataaaataaaaataaaactgacagtaacaagtgttgacaaggaagtggagaaattagagcttttatacatggcaggtgggaacataaaatattgtatccactttggaaaacaggttggtatttcatcaagatgttaaacagaattgccttatgacccaccaactcaacacctagctatatatctgagagaaatgtaaacgtatgtccacaaaaaaaattatgcacaaatgttcatagctcattcataaaaccaagaagtggaaataacccaaatgaatggataagcaagatgtggtatacctacaatggaatataactggacaataaaaaaaaatgaagtagttatccatgctgcaacatagatgaaccttgaagacattatgctaaatgaaataagccagtcacaaaagaccacatgctatgtaattccatttatattaaatgtccatgggtgggcgtggtggcgcatgcctgtaatcccagcactttgagaaactgaggcgggaggattgcttgagccccaaagtttgataccagcctgagcaatataggggagactccgtctctataaaaaagtaaaacatggccaggtgcggtggctcacccctataatcccagcactttgggaggccaaggtgggtgcgtcacctgaggtcaggagttcgagaccagcctgaccaacatggcaaagcctcatctctactaaaaatacaaaaattagccgggtgtggtggcatgtgcctgtaatcccagctactcaggagactgaggcgggagaatcactttgaacccaggagacagaggttgcagtgagcgagactacgccactgcactccagcctgggcaacagagcaagaatccacctcaaaaaaaaaaaaaaaaaaaaaaaagtaaaacattagccaggaatggtggcaggcacctgtggtcctagctactcaggaggctgagacaggaggatcacttgagcctaggaggtagaggctgcagtgagccgtgtttgtggccactgccctctagcctgggtgacagtgagactcttcctcaaaaaatattaaaaaagagagaaatgtccagaagagtcaaatttatagaggcagaaagtagattagtgcttgcctagggctgggggtggtgactgggggagtagggaatgggaaatgactgccaataggtacggagtttcagctgggtgcggtggctcatgcctgtaatcccagcactttgggaggctgagggcgggggtggatcacctgaggtcaggagttcaagaccagcctgaccaacatggagaaacgctatctctactaaaaatacaaaattatctgggtgtggtggcgcatgcctgtaatcccagctacttgggaagctgaggcaggagaattgcttcaacccgggaggcagaagttgcggtgagctgagatcacgccatttgtactgcagcctggacaacaagagtgaaacctcatcttaaaaaaaaaaattagtaagcatcagaatcacgggggagatgtattttttattttatttatttttatttttcataaatagagatgggatcttgctatgttgcccaggctggtcttgaacgcctgggctcaagcgatcctcctgcctcagtctcccaaagtgctgggattactggcatgaccagcctagatttttgaagtgtaaattttctagttctgacctagagactaggcctggtgtggagcccaggaatctacattcttaatctctccaggtaattctaatgtttgtgattcagaagccataccttgggaaacaaaaaaataaccctgaaggcgtaggtgtccagtagcttacacaaaaaaagatgaatatagtaatgataactagcaaatattgagtgcttactaggtgctaagtactgttttaagtgctttacacatattatctcatttagtacatgtaccgttacaagtgctatctattatttctccatcaccaatgaggaaacagaggcacaaagaggtttagtaacttgcctaaggtcacatggctagtaagtggcagaaccaggatctgtctgttagctctagatactgtggtcaagctgctctgcctgagaaaatgagaagaatttgggttgtgttggattgggttgtgttgggttgggttgcgttgggttgggttgggttgtgttgggttggattggggtgctttcttgttgtagctgagaaggaagggtagggaatagaaaggaaggagataataaaggagcaatcatggtgttttgttttgtttttttcctgtgacaccagagattcctgtgatatgtgggttacctagagaggaagaaattgaggtgctaagatactaagtaaccactggaatgagtgaattgcaatcagtttttaatgaccttgcatctttccattcaagaatcagcattcttggaaaaagcgcaagattgattaagattaggtcttgtgcccaatcttaatcagccagaaaagtgtatctgtgagaagtcagatgatgaatttaccatattcgcctgaggacagcacaccctaaaggcaattggatgaagtcagttcgaggaaggcgaaagggtacagtcctgtgctgcataaagacattttggtcaacgttggactgcatataccacagtggtcccctacgattatagtggagctgaaaaattcctcttgcctactgatgttgtagccatcataacatcgtggcttaatttgttatcttttctatgtttccatatgtttagatacacaaatacttaccactgtgttacaattgcctgtagtatccagtatagtaacatgctgtacaggtttgtggcctgcaagcaataggctataccatatagcttaggtgcgtagtaggctttaccatctaggtttgtgaacctgctaataataatagtgatgacaaagacagacccaggcctccctgtactgtggtttatagtctagcagggagtcatacaaaatagaagtaagcaaacaaaataattagggactgtgaccacaccaaaataagtagggattgtgagggcaaaagaccaggaagaatgataatgaataatggaggacctactgtatattggatggtcaagaaaagcctttctgaagaggtgatatttcagctgacacccaaaggatgggaaggagccattgatgtaaagagttggcagtggtatgtattggaaggaggggatggaggttacaaacagcttgtaatgagggaggccaatgtagtcggagtgatacgagcaagatgtgagactggagaagcaggcaagggccagatggccttggtggactatggtgctaagttggatttttattctaagagaaatgggaagtgcacggaagggtttcaagttgagttggaacataatcatcatttaaagtttaaaaatatgcctctggccaggcacggtggctcacgcctgtaatcccagcactttgggaggcccaggtgggtagatcacgaggtcaggagttcaagaccagcctggccaacatggtgaaacaccatctctactaaaaatacaaaaattagccgggcatggtggcaggcgcctgcaatcccagctacttgggaggctgaggcaggagaatcgcttgaaactggaaggtggaggttgcagtgagccaaaatcacgccactgcactctagcctgggtaaacagtgtgaaactctgtctcaaaaaaaaaaaaaaaaagaaaagaaaagaaaagaaaatatgcctctaaggctgggcatggtgattcatgcctgtagtcacagcactttgggaggctgaggcaggaggattgcttcagcccaggagtttgagaccagcctggccaacatttcaaaaccacatctctaccaaaaaaaaaaaaacaaaacaaaaaaaaaaaactagccaggtgtggtggtgcacacctgtggtcccagctacttgggaggcttaagtgggaggatcacttgagcctggagggtcgaggctgcagtgagccatgatcgtgccacactgtactccagcctgggcgacagagtgagaccctgtctcaaaaaaaatttttaaaaagacacagcaaaggcctgatctgtgtgactgcggattttttaccagaagacaataaactacataaaaatttaaaaacaaacagtaacaaccacgtgggtgggtgtggaagtcagtagcatgtacgaaaaggtcattaaaggcttctttgaggtcgcaaaagtaaaaagggcctgatccagttcattgtacagattgggaaaaataaagcccagaggagcagtgccaggcccaggatcacacagcaagtcaatagtggcacttggcccagaaaccagggttctcactatcggccttttatactaacggcctcctggtcctgggctggagtctcccgtgaggcccactgggagacccatataccagctccctcctcaatctgagacccaagtattgtaagggcccaaaagaaggatttggatttacataacgccctgaggacagatttctgaaacccttccttcctgtcccctactcacaaatacccactattgtaaaagctatcctgtagcaacaagaccaaaatgtaaacttggcctaaaactggaaagctgtagataggctcttgcacctccaactttctttctctgaatccctctcactccccaggagccacactccctacaactgtgcatccaggcctctcatccccatcccccaaatatacacacatttctctgctctgagaaaggagataggtttgcttgttgcttcctggtatccattccccctttccctgacatccattagaaactcaaagatggctgggcacagtggctcatgcctgtaatcccagcactttgggaggccgaggtgggcggatcatgaggtcaagagatggagaccatcctgccaacatggtgaaaccctgtctctactaaaaatacaaaaattagctgggcgtggtggcatgcgcctgtagtcccagctactcgggaggctgaggcaggaaaatttcttgaatccgggaggtggaggttgcagtgggccgagattgtgccactgcactccagcctggcgacagagcgagactccgcctcaaacaaaaaaaaaaaggggaactcaaagatttgctgaatgaatgaatgaatgtgcaaatgaatgaatgaatgaatatctctaattcctttcttaaaactcttcattggctttccattgcacttaatttaagaaccataattctgaggccgggcacggtggctcacgcctgtaatcccagcactttgggaggctgaggcgggtggatcgcttgaggtcaggagttcaagatcaggctcagggcttagacatcccaatgataactgagactttgagctttgactcagagggaagcacaagggcgagttccagatgacaccctaaggctcatcttagggtggaagtctaaagtggtacagcactttgggagagtaacttgacagcatctgttaaatttgaaatgtacatacctatcaatcttgcagttgacttctctgaaaactattctgtatatccaaggatagtcactgtagcattcattgtggcagctaacatggtgaagccctgtctctactgaaaatacaaaaattagctgggcctggtggcatgcttgcaatcctagctactcgggaggctgaggcatgagaatcacttgaacccaggaggcacaggttgcagtgagctgagatcgtgccactgtactccagcctgggtgacagagcgagactctgtctcaaaagaaacaaaaagaaagcatatactccaagcattatctattacagttgccttagtcatttacttcacactcctacgggcctcagaatactttgcaacaatctttactatctccgacggagtgtacagctcaacattctttatagccacagggttttatagacttcacatcatcattggctcaactttcctgctgccttctacgccaactaccatttcactttattcaccgttttggatttgaagctgctgcttgatactgacattttgtagatgtagtatggctatgccggtacgtttctgcctattgaagaagatcatgttcttttagtattaaacagtacagttgacttccaatcaattagtttatatataggaatcttgtgtagcctgcagtggggttgtggggagcaaggcagaagcagccactccagagaggatttacatttatttcttccaggcatctgagagatcatttcagagtgggtcgctttttatattaatttctcagcttcgagattcccagccatgcaggtgatgcaaatgtgaacgccagactcatggagggtaggcatgtggtttcaaattctcaggagattattttccctcttacccaaagaccaggtcaagatggacacatcctttttgtctcccttcgctagtaggtgttggtttttcccctagtttgttctttcactgtgggtgtagcccttcaagggtcctagatttatcaagggtctcagttgcaacctctaatttcatataagcccaaagcttcaactccccaaatgtttctttaaaaacacaagctattgcagattcagttgtgccttttaaaggatgtttgttgtttttatttccagcatctccttgggttgtgtagcaggaagttcctgatattgtcagaaaaggaagtccaactcagtatttagtacaactgtctgtttacttgtctattttctccatgagtgtcaagctctgggaggtcaggaactaaggctgactcatctctgggacaaaacaccaggcccaagatctggcacaaagtaaatgctcagtgcgtttgttgatactgaacctccacttggtcacttctaatgatggggagctcactttctcccaaggtggcctctttcctttagagagggtgtgtgacctgagtgaccaccgggctaatgggggacagcctgcccctcatttatgtacaaccttcccaatacttagcttgtccatccagattctgcagaagggggctcaaggcctagacatcccagtaataactgagactttgagctttgactcagagggaagcacacgggccagttccagatgacaccctaaggctcatcttagggtggaagtctaaagtggtacagcattttgggagagtaatttgacagcatctgttaaatttgaaatgtacatacctatcaatcttgcagttcacttctctgaaactattctgtatatccaaggatagtcactgtagcattatttgtggcagcaaacaattgaaaaccacccaaatgtctgtcaataagaataactaaataaattctctaaagtcaagtcatacagtggaaaactgtgagccttttatttttgtttttttgagacagggtctcactctgttgcccagactagactgcagtggcgccatcacggcttactgcagcttcaaccttctgggctcaaaggatcttcccaccttagcctcccaagtagctgggactacaggtgcacactaccacacttggctaattactttttatttttgtagagatgaggtctcactatattgcccaggctggtctcaaactcctgggctcaagagatcctccaacctaggcctcccaaagtgttgggattacatgcgtgagccaccacacctggcctatgtttttttttggtttttttttttgagatggagtctcgctcttgtcacccaggctggagtgctgtggcgcgattccggctcattgcaatctctgcctcccgggttcaagtgattctcctgcctcagcctcctgagtagctgggattgcaggcgcctgccaccacgcccagctaatttttttacttttagtagagatggggtttcgctatgttggccagtcttgtctcaaactcctgacttcaggtgatccagctgcctcagcctcccaaagtgctgggattacaggtgtgagccactatgcccggcatgttttttttttttaataaggtagatctatgtatattgacataagtggaattccaagacatgttgctgtgagtctgtaagacagagtgtataatatcaagaaaacagacaaacctataagcagtgtaaattggtacatcatggaggctatttggtaatatcagtcaccttttttttttttttttttgagatggagtcttgctctgtcacccaggctggagtgcagtggcgtgatcttggctcactttaacctccactcccgggttcaagcaattctcctgcctcagcctcccgagtagctgggaatataggtgtgtgccaccacggccagctaatttttgtatttttaatagagaaggggtttcgccatgttggccaggctggtcatgaactcctgacctcaggtgatccatctgccttggcctcccaaagtgctgggattataggtgtgagtcaccgtgcccagcctaagtcaacttttaaaatgctatttaaacttttaaaataacctcaactgactaatccccactaatagatatttatattacaaataaatatgcaaaataatgggtaaaaatattaattgccacattgtaataacaaaatattggaaacaaactttttctccttatgagactggatatatagagtgcatctatttgatgggatactatgcaggtttgaaatagaatgaggctgctctccatatcgatatggaaaggtctgcaagatagagtatgaagtgatgaaaaaacaaggtgcagaatagtgtctctatgtttatgaaaaatacatgtattatatgttggattttattattttattattaattttttgagacagcatctcacatctcactctgtcacccaggctggagtgcagtggtgcaatcatggctcactgcagcctcaacctcctgggctcaagcaatcctcccacctgagcctcctgagtagctgggaccacagggctacaccaccacgcccagctaatttttgtatgttttgtaacaacagggtttcaccatgttgcccaggctggtcttgaactcctgggctcaagtgatgctctcgcttcagcctcccaaagtgctaggattacaggcatgagccaacatgctcactctgcattggatttgaaatgcatagaattcctctggaaggaatcacagggaactggaattggttacctccaggaaggagaccaataattgggaactgggaagggaaggacacctgcaaacgctgtactccctattgaagctttgtaattttgaactatttccttacaattaagtaaggaagtaaaaaatgttaaaccataattgtaaaactggaagcaaaacaagctgtacaaaacactttctatatgtacatacacatgttgtgtagaaaaagaaaagaaggatacacttcagactggtggcagtggcagaagttttctgggactggataacaaagggtggtcaagggtgaccttgactttatctttttgttgttgttggggttttttgtttgtttgtccgttttgagacggggtcttgctctgtctccaggctggagtgcagtggcagaatctcggctcactgcaacctccgcttcccaggttcaagcgattcccctacctcagcctcccaagtagctgggactacaggcgtgtgccactaagcccggctaaattttttcattttagtagagatagagtttcaccatgttggccaggatggtcttgatctcctgacctcctgatccacccgcctcagcctcccaaagtgctgggattacaggcgtgagccaccgcgcccggcctgttgttgttgttgttgttgttgttgttttttaacatacagggtcttgctttgctttttttgtttgtttgctttggggttttgtgtttgtttgttttggagttttttgtttatttgttttgagatgtcatccaggctgcagtacagtggtgcaatcatggctcactgcagcctgaaccttccaggctccagcaatcctcctacctcagcctctggaatagctgggactacaaatgcatgtcatcacatgtcgcttttatttttatttttattttttgtagagacaggggtctcatcatgttgctcaggctggtcttgaattcctgggctcaagcagtcttcctgcctcagcctcccatagagctgggatcacaggtatgaaccaccatgcctagccttgcttagatttttatataatctttctgttaattgttactttttttttttgagatggcgtctagctctgttgcccaggctggagtgcagtggcacgatctcggctcgttgcaacctctgcctcctgggttcaagtgattctcctgcctcagcctcccgagtagctgagatcacaggcacctgccactacacccagctaatatttgtatttttagtagagatggggttttgccatgttggccaggcagctggctggtttcaaactcctgacctcaagtgatttgcccacctcggcctcccaaactgctgggattacaggcgtgagccacagtgcccagcctgttacatcatttaaaatccattttaatctttaaaagtaggcttcaggtggatggaacacaaccacagcctggcaaaggaatgaggctgactctcctccttctgagggaagtattcatgttgtgctctttgtcccactgccttccccaaggacagcctggctcagtggaggcaccggggctactcctggcatcattccagagagcctctcttgtcacctcttacccacttggctccctgtcaccagtgttctgggctgggctgagaagcagcacagattaactattgggttgtatctccagaagccccatcgatgtcaggttgggcagagccagcccaggaaacatggaacatctgcctctggcctctcacctctttgttctcctacgaagcccggcttttttttctttttttgagacggagtctgctctgtcacccaggctggagtgcagtggcgcggtctcagctcactgcaagctccgcctcccaggttcaccccattctcctgcttcagcctcccgagtagctgggactacaggcgcccgccaccatgcccagctaattttttgtatttttagtagagatggggtttcactgtgttagccaggctggtctcgatctcctgacctcgtgatccacccgcctcagcctcccaaagtgctgggattacaggtgtgagccaccgtgcccggcttgccctttttttttttttttatagattttggcagttacttggaatattctttccctttgatactccactacctttttcctcataccccaatttatatttctgtctcatctcattcagtggagaggaggcatctgaaaaacccatcaactagatgtgcagggatttaatgttcctacattaattgtattttaggaggcatctaaaaaggacgatgcttaactatgaggaaacacacaataatgatggaattcctagcaccggtggagaagagatcctgaggcagaaaggccttgctatcactcttcagtcatgttgataggcaatgctacaaagggcttaagaacgtggcactgaggctgggcactgtggctcatgcctgtaatcctaacactttgggaggcccaggcaggaggattgcttgagcccaggagctcaagaccaacataggcaatatagggagaccccgtctctatacacaacaacagcaacaaaaattagacaggcatggtggtgcatgcatgtagtcccagctaatggggaggcagaggtggaaggattgcttgagcccaggaggttgaggcttcagtgagctgtgattgcaccaccgcactccagcctgggcaacagagtgagacctcatcttaaaaaaaaaaaaaaaaggccaggcccagtggctcacgcctgtaatcccagcactttgggaggccaatgtgggcagatcacaaggtcaggagattgagaccatcctggctaacatggtgaaaccccgtctctactaaaaatacaaaaaaattagctgggtgtggcggcgtgcacctgtagtcccagctgctgcagaggctgagacaggagaatggcatgaacccagggccaagaccgcaccactgcactccagcctgggtgacagagcaggactccgtctcaaaaaaaaaaaaaaaaaaaagaatgtgggcactggagccaggctgcaggctgacagattcgtatctgtcacttagcagctgttgaacctttgacaaataacctgtctgtgcctcagtttccaaatctgcaagatggagataagagtagctcctttataggactgttgtgaggctgtaatgagatattacatgaaaagcctgtagtcccagctactcaagaggctgaggctggagtaccacttgagcccaggagttcaagtccagcctgggcaacatagtgagaccctcatctctaattaaagaaaaaaaaagagatttaatctctctgtaatccccatcactttgggagtctgagacaattggatctctggagcctgggagtttgagaccagcctgggcaacatggtgaaaccccatctctactaaaaatacaaaaattagccgggcatggtggcttatgcccatagtcccatatactcagcaggctgaggaacaaagaattgctcgggcccaggaggcagaggttgcagtgagccgagattgcacttgggtaacacagcaagactctttctcaaaaaaaaaaaaaaaaaaaaaaaaaaaaatcggccgggcgcggtggctcacacctgtaatcccagcactttgggaggccgaggcaggcggatcacgaggtcaggagattgagaccatcctggctaacatggtgaaaccccgtttctactaaaaatgccaaaaaaaattagcaggtcgtggtggcggccggcgcctgcagtcccagctactccggaggctgaggcagaatggcgtgaacccgagaggcggagcttgcagtgagccgagatcgcgccactgcactccagcctgggcgacagagcgagactccgtctcaaaaaaaaaaaaaaaaaaaatcaaagggcctccgatctatgccaaccactccttaagatccctttggttctcaccaatctctcatatcccaccactgcctttcagtggccttcactcaccaaacctgttactcttcatcaaaaactgtacccctaggccctttccctcaggcctcgctttttttctttttttcctctcacctctccatcctgtccctgttaccctgttatctcagttccatatctcaaaagcctagaaaggcagacaagacagagctctccttaaaaagtgatgggcaggccagctgtggtggcttacgcctataatcctagcactttgggagatcaaggcaggaagatcacttgagaccaggaattgggcaacatagtgagacgcggtctgtacacaaaattttaaaaattagctgggcatggaggtgtgtgctgtagtcccagctactcaggaggctgaggcaggaagattgcttgagcccaggagttcgaggctgcagtgagccacgattacaccactgcactctagcctgggtgtcagagaccccatctctaaaaaataaaaaaagtgaaggccaggtgcagtggctcacacccgtaatcccagcacttcaggaggccaaagtgggaggactgcttgagcccaggaattcaagaccagcctgagcaacaaagagagagagagagagagagagagagagagagagagagagagagagagaaaggaagggagggagggggagagagagagagagagaaagaaaaataaattagccaggcatggtggcacaggcttggataattttttaaaaactatttgtatagaaggggtcccactatgttgtccaggctggtcttgaattcctggcctcaaacaatcctcctaccttgacttcccaaagttctgggattacaggcgtgaagcctgcgtgtatcgattttctattgctgtgtaacaaacaaaacctccacagacctaggggctcatgacagcacctgtttattagctcacaattctctaagtcagaagtctaggcacatctgggttctctgcttgggatcccacaagtctgaaatcaaggtgttggccaggtgtgtcctcatatggaggcttgactagagaaagatcaacttccaagctccctctggatgttggaagaattcattttcttgtgaccatattagcaaggccctgttttctcactttctgttggcaggggaccactctcaactctcagcttgtagaggtccctcttgggtcctcctcttgtggccctctccacacatagcatttggtccttcatgggagcaccagctgctggaaaaaatgattctgttaggtaaaaatactatacatttttgaaacatgcaccaattatttagctctgtgattgtgggcaatttcttcaagcagcctgagcctcaatttccttatttgtaaagctgggaaaacaacgatgcccatcttggagggttacaggcacatagaaaaacaatcaataaatataagctgctgtttacatttgttctttttttaaaaatttttaaattttatttatttatttattttgagacagagtcttgctctgtcatccaggctggagtgcagtggcgtgatctcggctcactacaacctctgcctcccaggttcaagtgattgtcctgcctcagcctcccaagtagctgggattacaggtgcacaccaccacgcccagctaatttttgtgtttttagtagagacgggttttcaccatgttggccaggctagtctcgaactcctgaccccagggcatccactgcctcccaaagtgctgggattccaggtttgagccaccacaccaagcctacattagttctaacgaatagacagggtctagacacagtgagattagatgagtgagggacagggttccctacatggagaaaactgcaagagccaaatcttggaagcaggaaagctggtggtttatttgtgaagggtgtgtgtgtgcgtgtgtacagagaacgctgaaagagtaggtgaacacagttttgcttatccctccagtcagaatttactggatgcttactgtgtacccagtaccatgaaagggtgcccggccagcagtgtgaattcagcctggaagtgggagggagccaaggaagagctctgagttggagagggaagtggtctaagcttcgggaaatttatctgctcctagtagagtggttgactcagcaggagagaacccccttctcttctgcaccctctcctccctagcctcaaagcctgctaaggacccagttcccaagcagagacccaggagggagttgcagaatctggccctgtctggacaagacagacagggtgcgactccagatgccagttcctttctttctgctcctgaatggccccaaagctatcccttctcaccacaatggtcaaggagggatacagcaatttctcttttaaatgttacacatagggctgggcacggtggcctctaatcccagcacttcaggaggccgaggtaggaggattgcttgagcccaggagttggagaccagcctgggcaacataggaagacccctgtctctaaaaaaaaaattagaaaaataaagttctaaatgtgggaaatcatgctgggcactcaactacagcagctcacttgggtacttgtccacactcacaaatatagccctgggaccccaaagtcactgtcccaccctcacaccatgggcagatggactcaaactaagccaggcttttggctttctgccacttgcctcttctctctgaagtgaatcctgtcctgatcatcacctccttgctgacagggccattaagcgcagttcacacaaacaaaccacgatgccttgaggttgagactgggaggtatgttaagggagcatggagccagccattctgcagatggggaaactgaggcaaagaaaaaggaagtgacttgcccaggctcaggcagtgagcccaggacagaccaagactgaaatctgacaatcagcccagggtttatacacacacacacacacacacacacacacacacaccccacaatttgagttacgctcaaattcagacatcgtgggttgaacaacaaagctttttttttttttttttttttttttttttgccagagtcttgctctgttgcccaggctggagtgcagtggtgcgatctcagcttactgcaacctccacctcttgggttcaagtgattcgcctgcctcagcctcccgagtagctgggattaaaagcacctgccatcactcctggctaatttttgtatttttagtttcaccatgttggccaagctggtcttgaactcctgagctcaagttgtgtgccggccttagcctcccaaagtgctggcattacaggtgtaagccaccacacctgggccacaacaaagctttttgaatagaagttcttggaatatggcctcttgttaatgtgtaggcccatctgttgggggaatttggggattatgcctgctctagctggctttaccaattaaatgttttcccctctctgtctcagttttttcaccggtaagataggaagaatttattatctatgtcagagggattcctctcagcctcactctctatctcaggtcggggggcaggggagggtggggaaggaaaggagtggtgggccagtcctccagctaagcacacagactggcccatacctgcaagtacacacaaggtcccttgagcgacacacccaggctgacacatcactttaagggggcacggaggggggcaggcagtgggagtggcaagccagtggggagcccccaggtgagggcaagcccgaggaatagaagggtggcctctttttttttatttttgtttttgagatggagtcttgctctgttgcacaggctggagttcagtggcgtgatctctgctcactggcaacctctgccgcccggattcaagcaattctcctgcctcagcctcccaagtagctgggaccacaagtgcatgccaccacgcctggctagttttttggtattttttagtagagacagggtttcactatgttggccaggctggtctcgaactcctgacctcaggtgatctgcctggctcggcctcccaaagtgctgggattataggcgtgagccactgcgcccggcctgaagggtggcctcttgacctccagtcctgcagcccatgaaattgggcaggtactcacacctgggcatgggttagatgggcgtgggtccctagtaactctgagtatgagctcatgtgcatgtgtgtatatgtttatatatggatgccttcattgtatgcacagatacccatgattatccatgtgtgtgcataggaatggcaccctctgtctgattggaaatgagactccagagttaccccagcatgatgttcactgccttttttttttttttttttttttttttttgagacagtgtctccctatgttgcctaggctgaagtgcaaccacccaggctcaattgatcctcccacctcagcctcctgagtagctgggtcttcaggtgcaggccaccacacctagctaatttttgtatttttaatagagacaggattttgccatgttggccaggctggtatcgaactcctgggcttaagcaatcctcctgccttggcctcccaaagtgctatgattactggcctgcactgccgcgcccagctctgctgcctctttttacagcctgccggcccagaccagagtctcagaatactaagcccactttctggggccagggtcagtagatagctttgctgctgtatgattctaagcaagtatcttgacctgcatgtgtctcagtgcacctcagtttcctcacctataaaatgaggggtttggatgagttgaggtctgaagcctcctccagcccaggtaataaatctttgtagtggacaggaggaataggtcctaggggtttcaggaggggacttccatgggtacctctgactctacagagaaatggaagactgagatctgacttagcagcctagaaagacttagcagcctagaaatggggttcagctaattctgggaacagagtccggtcacttaaggtaccagagtgtagccaagagcccccttttctgggcttggggaaccagaaccatgtgttcaacagaccattgcctgtacacagggtagagagtgcaggtgtatactcctgaaccagccacccttcttttttttttttttttttttttgagatggagtctcactctgtcgcccaggctggagtgcagtggcacgatctctgctcactgcaagctccgcctccccggttcacgccattctcctgcctcagcctcccgagtagctgggactacaggcgcccgccaccacgcctggctaattttttgtatttttagtagaggcggggtttcaccgtgttagccagaatggtttcaatctcctgacctcgtgatccgcccgcctcagcctcccaaagtgctgggattacaggcgtgagccaccgtgcccagcccccagccacccttcttaagcttcaagctataactactgagcctgtgatgaaagtctactctatgccagacccccacaagctgggtgcgggcagtatagggacaaagactctgcccttgggatgccaaccatccacttgagaagacacatacacatacaatgagtcatcatcacttactgtttatggacaaataaacgtccatcaaggtagccatcaactcgtgggtagggacaaggaaggctacctagaggaagaaagggtgagtagaatctctccctctctctctcttttttaagagacagggtctggctctgtcatccaagctggaatgcagtggcttgatcatagctcattgtaacctaaacccaagtgatcttcttatttcagcctccctaagcagctgggactacaggtgcatggcatctggctaattttctcattttttgcagataagtggtctcgctatattgg

SEQ ID NO: 33 - DNA, 5656 bp, Homo sapiens
acaatgcaccgcacaatggcccgaccgccgccactaccggggcctgagggggcctggcggagcccgagcgcggcccggcccgcagcgtggggccccgagcgcggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggtgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgtt

SEQ ID NO: 34 - DNA, 697 bp, Homo sapiens
ggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccata

SEQ ID NO: 35 - DNA, 140257 bp, Homo sapiens
gatctagaacaagacaaagatgcctactttcaccacttttatttaacatagcactggaagtcctagccagagcaattaggccacaggaaaaaaaaggggggcctccaatttgaaacgagcaagtcaaatagtccctgtttgcagaggacataattgtgtatatagaaagccctgatgactccatcaaaaaaaaaaaaactgttaaaactaataaattcagtaaatttgcaggatacaaaatcaacctataaaaattagtagtatttctacacacaatagtgaacatctgaaagagaaatcaagaatgcaatctcacttataatagctacaaaaataaaataatctgcttaggaatacatttaaccaaggaggtggaagacttctacaatgaaaactataaaacatcagtgaaagtaattgaggaagacacacataaatggaaaaatatcccatgttcatgatttggaataaataatattgttaaaatattcatactccccaaagcgatctacagattgaatgcaattcctatcacaacaccagtaacagtcttcacagaaatttttacaaatcctaaaattcatatggaacaacaaaagaagttaaatagccaaagcaatctttagcaaaaagaacaaagctagaggcatcaaactatctggcttcaagatataatacaaagctatagtaagcaaaacagcatggtattgacctaaaaataggtcaatagaacaggatagaaaacatggaaataaatccacacacttacaaccaactgattttccacaaagacacccagaaaacacattggggaaaggacagtttcttcaataaatggtgctggggaaactggatatccacatgcagaaaaattaaactagacccctatctctcaccatacaaaaaaatcaactcaaaatggattaaagacttaaatgacttaaatgtaagacctgaaactataaaactactggaagaaaacatagccataggggaaatgctccatgtcattgttctgggcaaagaattttggacaagaactcaaaagtctaagaaacaaaagtgaaaatagacaaattggattacatcaaactaaaaagtttctacacaacaaaggaaatctattttcattttcttacatcaatcaaagttcgccccattcctgctatggggttgatgggaggtgccaggccctttggctctctaatgctcgcctgcctggaaatgctactcttcccctccgggaaaagactcagggaaagcttgcctatggcatgatcatagctcccccttgacaaatgtaaaccagtggttcctcatctttagcatgcatcagaaattaccagaagggcttgttacaatactgattgctggaccacactcccaggatttctgattcagtgggacctgataaatttttatttctaacaatttccagatgatgctgatgctgccggtccagggaccacagacaataagttatgtcaatagttccaaactacctcagtggtgtttagacttttgaatatacaagcatcatcaaggagttattaatgatgaagattctagatcatcaagagaaataaaatgtaagccacatatgtaattgtaaggtttctaatagccacgtttttaaaaatcaaaaggaaaccatgaaaccaatttttaagatatactttatcccaatacattcaaacttttaccatttcaacatatagtcaatatcaaagtgattaataaaatattttccttattttatttataccaaattttccaaatcaagtgtgtattttgctcaatgcagtttcagatgacccataacaactgggggctcatagctcctgtcccagacagtgccgttctagggccttcccttgggaaactctagaagctgctcttctagaaagcccttcctgcctccctcccacccctgaacttccctctagcaccaaaaaattcataccaactttccctaattcagtgcttctcaaccctagctgcactctggaatctcttgagggactttaaacatcctgaggcttgggcttcacccatctgtgttctgatgtcagtggtctctggcgcagcccagcaatgggatagttttaaatctctccaggtaatcctaatgtgcagctctagtcatcgcatggaagctccctgacccagcgggactgttagctcctgaagacagtgttcctcacctcctgggaccatgcaagacgttctcaatcccaggcctcatccagaactgctgagttcaatctgacatttttataagattgccaggtgatttctctgcatattgaagttcgagaagcactaccttaaggggagcaattaagaaattaattgggcaaatgtttcgcattgtctgtgagagagctaaataaatcttctctaccctccaggctgggggccaggcctagtgaaactcctcagtagaaagatggaggttgtgcaaagggttcttggagggcatgtggctctgaatccagtccagccattacacttgctgttctatgtttggaaaaccacttgccctctctgagcctcaatttatacagccataaaatgagggaaatgggcataataaaaatgataaaagtctagtttacagatgtggggaaaagaaagagagatcagactgttactgtgtctatgtagaagcagacataacagactccattttgttctgtactaagaaaaattcttctgccttgagatgctgttaatctgtaaccttacccccaaccctgtgcttgcagaaacatgtgctgtgactcaaggtttaggatttagggctatgcaggatgtgctttgttaagccgatgcttgaaggcagtatgcttgttaaaagtcatcaccactccctaatctcaagtactcagggacacaaaacactgcggaaggctgcagggacctctgcctaggaaagccaggtattgtccaaggtttctccccatgtgatagtctgaaatatggcctcgtgggaagggaaagacctgaccatcccccagcccgacacctgtgaagggtctgtgctgaggaggattagtaaaagaggaaggaaggcctctttgcagttgagataagaggaaggcatctgtctcctgctcgtccctgggcaatggaatgtcttggtataaaacccgatggtatgttccatctactgagataggagaaaactgccttaaggctggaggtgagacatgctggcggcaatacagctctttaatgcaccagatatgtttatgtatgtgcacatcaaagcacagcacattttctaaccttgtttatgacacagagacatttgttcgcatgttttcctgctgaccctctccccactattaccctattgtcctgccacatccccctctccgagatggtagagataatgatcaataaatactgagggaactcagagactggtgccggcgcaggtcctccgtatgctgagcgctgatctcctgggcccacttttctttttctatactttgtctctttttctctttcttttctcagtctctcatctcacccaacgagaaacacccacaggtgtgaggggcaggccaccccttcatcagaaccatttttcttggttaataattttcaaaaatcaaattggtttctaccattttaaaaagggaatttgacataatatccccaaattctagtttatcctaaaaaattcaaagatctggcagctccaggtccatatttattctggcagacagttaggtaaagcaattcactctccaggtgctcacaacctcacccagccccgccgctcgttacagtactcacctagcgcaggagaaggttgagtttgacaacttgtactgcagcaacaatatctaagctggaactgtgcttcccagaattctttctgctttatgtttccaggccaaggttggccacaaaagaaacctgtagtgaactggaaggcagaagtgaaggcacatccagtaggctcagaagggctgggcgatgttgaagcacctgctcggtgttgctgattatgggccaggcctgcagctcttccagctccagtgagtcctgggccaggtgcgcgagcagagcagcctcctggcagcttccttctgcaggtcacctgtgacagatctgggttcttcttgtcccttgtgcattccaggttttccttattctcccctacttcctgtctctcagactctcagccctgctgatctatggtgagttcaggccaaccaccaggtttggagacaacagccttccatagacttcttcaccatcttccatacttgcataatgtataaccctagaagaaatctctagctccaaatcactcacagggattgatcagggaagcaaaaccttttatcaacactgccctggacttcacacatctccaaagcagcgattaaattttgtagtcacaggtcaatgtgaaaatcacatgagaactctgggatccctcacagacaatgcaaaacattttgcccaatggattcaatagaccagtgggtctcaaaccttaatgtacacatgtatcacctggggatcgtggtctctttttgaattgcagattctggtgcagcaggcctggggtgggggctcagattctgcatttgtaacaggttcccggagaatgctggtgctgctggtccagtgaccacacgttgagtagcaaggtgttcaaaggttcatgaacccctcatagaagacctcccctaaggtctctcctaattataatgtgcaattgtttgcccggcagtttggttgaatagattgcccaaactgagaggcaagtctggggtggcctgagcaatgtctgctaaacctcataataaatttccccatggatccccacaatgaagctgcaatgagacagaaagcccctcacaccatgggctttgcagctgttacagaacagctcagccaactttggtcagcacagccttacttctggaaaggggattcttgcctgccctgagcagggagtgagttcagacaaagaccttggcgatggggtactctcccccccacccacctgccgcctgtggtgaagtaaggccttcaccttcttcactttctcattgagttatacaacccagagcctaccagattgcgggtttctgtggactctgtcatccctatttacctttttctctagctcctggtccttcctgatacacatagtagatgctcaataaatgtatgctgactgaatgaatgaatatgcaattttcactatagtccatctgaaattaggctcccttggccatccagaccttctagggcttcccacatgcctcccactgtttatttgtgagcattcaaagtccagaggctcttgtcaccattgccctcaacacaagagagttagaaaggtaagacaaggctcaaggtcacaggcatggcttttagaggcaaagaagaaaggttaagagcagaggttctcaaatttcagcaggaactccagtcacctgtgaagactgttaaaaatgtagattccagccaggtgcagtggctcacacctgtaatcccagcactttgggaagctgaggcgggtggatcacttgaggtcaagagttcgagaccagcctggccaacatggtgaaaccccgtctctactaaaaaagtacaaaaattagccaggtgtggtggcgggcacctgtaatcccagctactcaggaggacaaggcaggagaattgcttgaacccgggaggtggaggttgcagtgagctgattacaccactgcactccagcctgggcaagagagcgagaatccatctcaaaaaaaaaaaaacaaaaaaaacaaaaaacaaacaaacaaaaaaccagaaaaacagattcccaaggcctcagcccagacctgctgaatgagcctctggaggtgggaccccagcatctgcattttaacacactccccagagactttggtgcctggtaggttaggttccacccctcatgacctacttctgtcctgcaaccaccctttgttagcataaaacatcaaggggtgtgttcgttcaccctttagtgcaacatacattgatgaaggtttcacctctcaccagcactgtgttgagtatggaggctacagaagaagataagacacatcactggcccccagtgagctcgcctacagcctagaggaggggcagacaagccaggaggcagtgtgttttccagtggttctgtgaggcactgcagggatcagaggagaaatctggcccagtgaccatccctgctggcacctgaaggctgagaaggaaagagccaggaaaacctcagtatgattgggacacaaaattccaggcagagtgtggaagagataggcttgagggtgtcaagtgcagaatctggccttccgtcctgggggcaatgatgacaggaatgcaacatgtgaaatccacacttcacagttaaactctcatgcgatgggcgtggagtgcccacagagtatgaataagaggtgaggaggaaatacccctcctggaaacaccatccactcttgagaacctaggtgactgtctcccatctgaaaagagtctgcaataaaatagtctttacaattattcagagttttccctgatcctgccaacctccgtacttgatttaaaatctttccatctggaattattagtccagagcagtttatcaaagaaaagatggatggtgcaagccgactgctgctagcgttcagaaaaacgtgttctctctctgccattcagcgaaagttctttaatcactgttgattggaggttaccaaccttgaattgttagttaatggcatctctgcaaaggaatgatttattgggtgagtaaacttcgcaaacaaacacagatcctccattgctggctatttcatcggaagctgaaatgtacattatttcaactgtctttctagtggaatcaaaatccgaagcagaggcaaatatttagccttgatctcagatttctctgccatcgagatattaagaatacagaaagtcaaggcacagaagaatccccagatgttctgtttccagtgttcgcctatgctctcaggctcccttgcagctggcaccccacctgggagcagcctcccttttgaggatcaccatcgggagaggagcctgtggttcaatggctgtacctctgtcacctttcaccaggaccctatcctgaaacaccagccagggccagcacaactcactgctggaggatccctgctctgccacctctccttggtccatttgttctcaagcaaatgacattggaaccaagaaaggaatgtgctctgtttgtcaattgtcaggcaggggacacatcttccctttcttccctcaaagagggactggttcagcctcaaaccctctgaagggcaagatcaggggaagcaggaatgctggagcttcctcagccctctccccagccgtgtgagtcacgggtgcaccaggctccctcctgctgtccctccactgggacactgccccctccagttcgctgttcatactcacaggcagctcgggcatttgtggggcttccccaacccccagactacgtcagacccctggagatacactctcctgattcacaaaccttttgtgtggcactgaatgtagttatgattgcatttttttctgtgtagttattagattaatttccatctcacctcttgggaggctcattgtttttgctcccttcagcatccctggtgcccagtgttggagctgtggttggtaactaagaatgaccagtggttagaatcacttgagagagcaagaaagcccctggaggtggcaggtggagagcaacgtttccacttcattacccagaggaggcagctgactcgggcgtgtagctcatgggctggccagcccttgctgctccctatgccacctgcagccaagtccctgggcagctcagcatcctcagctctttgttaacaactctggaggaggtaagcagagcaccagcagccagggggagatacagcaaaatctctgccatgatggcaagaggaccagagcccacacgtgacctcgggaggtagacaagtctccctgtgcgaggaccatcggggcagccaggagggctggtggagtttctgtagataggggtggggacaggactccaggatgagggcacagagtaagcaaaagcctggagggaggcccaagatggtctctggggtaaagatctgtagctggggttttgggcttcaggcagaaaaggcaggctcatggttcggaggccattgaatggaaattcccaggcactagggaaccactgatgggttctgatccagggaatgtgtggcgggggatcttctggggatgtttgtacccaacagatgagagacactgaagcagggagatttgtccagaggctgggggaagggtggcaatggggacaagacagagtttggggaggtgatgcatgtccaggatgacttcgcagcttaaaggctaagcaggtaggaaacagaggtgacagtgaccaggatgagagatgggccatcaacccaccacacatgaaacacgcagccaggtcagattgctgtgttccagggtcaagtctggtttggtgcaggaaggtgcagaagtttcttgtcacctccttttctcaccattcagaaatcagtgtcctcttaaagccataaagaagagtgatacatttgacttcatcttttttttttttttttttttttttttttagtttttgcatggaaaaagatatcaaaaaccaaaggacaaactgaaaaaaaggtaacatagataacaaacagagctaatatcctcatatactgtattagcctgttttcacactgctttcaagaacttccctgagactgggtaatttataaacaaaagaggtttaattgattcacagtctgtagggctggggaggcctcgggaaacttacaatcatggcgaaaggggaagcaaacatgctcttcttcacaaggtggcaggagagagagaagagaaagtaaagtggggaagagccccaaataaaaccaccaggtctcgtgagaactcactcattatcataagaacagcatgggggaaccgccccccgtgatccaatcacctccctccctcaacatgtgggatcacaattcgagatgagatttgaatgagggcacacagccaaaccataccacatacaaagcattcctacaaataaataaaaaggaccaccaacctatcagaaaaaaaaaaatgggtaaatgacaaaaacaggcagttcacaggaaaataagtggctcataaacataatttcatatgttccagcttcatttataatgaaagttatggaggttaagactaaaattacagaccctttttaagttattttacttaggctggtaaatatttaaaaactgataatacacactgctggtgggaatgttggaaaacaatttgtcaataggtattaacattgtaaacgtatgttcccattcctctaggaatttcactgctaggactgtatcctaacaatatgttcatgcatgcatagaaaaagtgtgaattagaatgttctcagcaggactgtttgttgtagcaaaaagccagaaatagcctgaatattctcagcagaaaactgcttaagttataacacagtcgtacaaacaatgacataaaaactctaaaaagtgcaataactatacctatgttgacagggcaggatctcttaggtggattgttaggtgaataaattaaagtgtggttcagtttacacattggtattaaaaattttaaatgatatgcatttctatttagaagatactatgaaccataatcacctctgtgaaggagaaccaaagagctcagatctgggatgggaaggagtccagctctgagctgttggagctttggtcctgtccttgtcaggccttctgagccactggccttccccacctgtgccggagcctccaccatcaggttaaagcccactgctgttgtttgtggtgttcagtcgccaacccatccatctctcagactggctctttcagaaagtaaaacagacagggccttggctccagtctccgacaatgtcaggaaaacttgctgaaagtggcctttcatttgagcctgaacactaaaggagaactggcagaaacacccacctgaaggcagctgggggctggctgacctttgtagctggtgggggccctggcgcccacactgctgtcggctctccccgggctgcctctggaaagcagtctcctaagtgcaatctctaggcccctgaccaaggtatttttagccaccctccctggtagccacggctccgaggctatgagcagagacttcaagggcagggccagggaacattcctgaactctgggtctctgctctgggcctggcttgttcccaaggctaatttagaactttcctggctactcttgtgaccttttgcctcatgacccttcccccagagcacaaagctctggccccacagttcctgacacagcactgtcttttcatggtgagcagtggcagagggacattgccttcccttcgaacaatgtggctttatggacaaatggagctggtgacactctgtcttgaagagcagcacttctaagctggaatgcagggagacactctctgtcccagggttcctgaagcttcagctccctgggcttcccacctttgctatattgacagttcctggttttccctgtgctgccggctgcactgattcaccctcttcacctatatattcactttagttgcatcctaaaacataggatatatgatatcatgggttgaacatgctagttgcttttttaatgcattaaaggaagttctatgagaatttatagaagggaaaaaagagaaaaagtaattcttacatgcatattggataagcagtgaccaggccagtggtgagaaacatggtgaactgccatccacagtttgcagaggaaaagttatttatgaccagggctttgcacattatttcttcttcatgatcacacacacacacacacacacacacacacacatcttgtctacctggataattgccatctcctccaggaagccatttccaaggccctcaccgccaacagcaggcccatgcccctccaccgtactctctgctcagcctgagacagccctgcaattgtgaccacctgccgattctcctctgtagtctcctgggaaacatgcctttttgttaaggggtgatggggaatgcgcactctggactcgaaccccaccttgttcatttctcagctgcataaccttaaacaagtggctcctttgctttctcccagccttgttctcctcatctgcaaaatggggtgaaaacagaaagtgagaattaaataacgtaggcaaaatggtaacacaggcttagcattcactaagcatttgataagtatttgccacgtgcatgtatgcatgaaggaaggcagcctgtgtacacgaaggaggttaaacaataacccacagcttcagatccaccaaaaatcttattacaaagacaagttcccggggcagtgatggtggtaagagtaatagcaatgacttctcaaaaaacctgtaagaggggtgttactattttccccattttaccgacaaagcaataaggactcaaagtgttgaatacacttaatcaagctcacacaaggtgaataatagagctggtgttaagccctggcttcctcccaaaccaaagccaatgctctaaatgcccacatcatgcgtctttcatacactgttttttgatcctctatgagacaccaggattggaaatgtgattcttttttttttattattatactttaagttttagggtacatgtgcacattgtgcaggttagttacatatgtatacatgtgccatgctggtgcgctgcacccactaactcgtcatctagcattaggtacatctcccaatgctatccctcccccctccccccaccccaccacagtccccagagtgtgatattccccttcctgtgtccatgtgttctcattgttcaattcccacctatgagtgagaacatgcggtgtttggttttttgttcttgcgatagtttactgagaatgatgatttccaatttcatccatgtccctacaaaggacatgaactcacccttttttatggctgaatagtattccatggtgtatatgtgccacattttcttaatccagtctatcattgttggatatttgggttggttccaagtctttgctattgtgaataatgccgcaataaacatacgtgtgcatgtgtctttatagcagcatgatttatgttaggcccacattcaagttcttcgtaattccatcatctaaatgagttttgagtttcatttctgactaacaacagtagaaatccgccttacattgctagaggaaccacatgcattcagtatctatgtgttcattctcacctcctcgtctccctggcaaatagatcatggtcacaggactagttctggccaatagaatttaatagccactgtgctttcttcatcttttcccctgccacagccaacctacaggcccaaattgtgcacttactggactttgcctgatgataaataaaccttcattgggttaaaagccttggtggttttacctgtttcagctgccagcattaatttctccgactgatacacagatgaatttcagggtgaatttctcactcaacttcccccacacattgcaaagcttgggctttatgccaccattttaataatgatagttattgaattataatactgtgagattatgatttttctttactattcttaggctgtttggcttttgagaaacaacttggtgtcatttcatattaataactgacttaaagaaagaggcaggccttccatgcagtgtcacctgtgtcatgaaagctaatagaagcagacagctgcctgttggggtcttgatttacaaatcgcatgacagatgaagtccataggcttccaaagtgggaggatgaaaactttaaaaaacaaaaccagaaactgggaaagtgaagacagtggccgccacccagctccatgataaactcccaagaggctgtgagccagcgtgggaagaacacagccctctcacctttggccccccaactctctcccagcctctctgtaaagaactttgcacatcacacaaagccaatcagcaaaatacaacaaaatacatcaactgctctgggaattacaagcagaattctgtgaagatcatactcctttcatctgaagaaactgaggatgtttttacaaataattaattcaattgatttaattctcaaggattaacttgaacgcctgaattcataactgaatcttttttaaaaggagaaatctagtacatgcaaaaatatagagactcaaaccttccttgtggtcataaacaactttcttgaaagagggtgttcgagccaaagccccgtgtttccgtttaccagtctgcgttagtctccgtggcatcatctccttgtaaatgtcttgtggcaatcctcgcccagctgtggctcttccctgggggatgatgcagcccctgctgaggctgaagcgatttctctctttagactacacaaagcaggtaagaggtgctcattagaaggttctcctggaaagctggacttccagttcatccccactgctacattcccgccagcaccatgacagtttacaaatgccatggcaacatcaggaagttatcctacatggcctaaaaaggggaagcatgaataacccaccccttgtttagcatatcatcaagaaataaccataaaaatgtgcaaccagcagccctcgaggctgctttgtctatggagtagccattcttttattcctttaccttcttaataaacttgctttcactttgaaaaacaaaaacttttgaaggaaatgttttcactccgggctggtttccaaaaacttgaatcaagcacaaaagtgaattcactggtgcaggtaattgtccaaggggagtcatggcttcttaactaggtgcaggacttaagcaatgtcattagaacccactccactccctctcagctcacttccatgcttcccacatctggtggcccccaaccactctgcctcttcccctcatgttctcaaggttgctgcaactgcccctgcacttacagcctctcagcttcaaagtccatccaaagagttggaaagaccctgggccccactctcactggctcagtttgggtaaaatgcacatctctgaactaatagtggtggccaacggggtgggctacattagctagttaaaatcttccaggatctgcctctggaacttacagaaacagaggatgaagagatggggaactacccaaaggaagtccagatgttttcctagaagaaggtgaagggatactgaaaaaaacaaaaacaaaacaaaacaaaaaaaagcaaacaaaaaaaaacccagatacttaaaacaccaacagaccaaagtttctctgctgtgattgacttcaaatcaccctgatgtcctggaatgctgaggctctggagaactcaggtggaaaaccctccagtcaaaatgaatcctcaatttttcaaatagacacaggcccagactggggaagtcacccagcaaaaaggtagcagagctccacaaaacttgattctggtgatggtatactatcatatcagattgtagatattcaatatatgtctttttttatattaacatatcagttatacctcaataaaaccaggggttgtgggggaaggtggcagaagggatccccagttcactttctttctcccttccttgtttttcaacctcagtgaagactgaatctcttgtctctcagtgaccatgtgttcctttgcttttatatattatttatttatttattcatttattcatttatttatttttggtggtaaggacacttgacatgagacctaccctcttaagaaatgtttaaatgtgcacatatacaccgtggaatactatgcagccgtaaaaaagaatgagttcatgtcctttgcggggatgtggatgaagctggaagccatcattctcagcaaactaatgcaggaacagaaaaccaaacaccacatgttctcactcataactgggagtcgagcaatgagaacacatggacgcagggaggggaacatcacacactggggcctgttgcggggtgggaggcaaggggaaggagggcattaggacaaatacctaatgcatgcagggcttaaaacctagatgacgggttgataggtacagcaaaccaccatggcatatgtatacctatgtaacaaacctgcaccttctgcacatgtatcctagcacttaaagtaaaatgttgaagtgcattgttgactatagatgctacgttgttgactataggtgctatgttgttgactataggtgctacgttgttgactataggtgctacgttgttgactatagatgctacgttgttgactataggtgctacgttgttgactataggtgctatgttgttgactatagatgctacgttgttgactataggtgctacgttgttgactataggtgccacgttgtgcagcagacctctaggactgattcctctcatgtaactgtaactttatacccgttgacaaacagatccccatctcccccaccccatctcctggaaactaccattctatcttctgcattttcatctgactctttttgatcactcacatcggtgaaaccttccaatcctcatccctctgtgtcccccttatttcacttaatagaatgtcttccagacctatccatgttgttgcaaatagtaggatttcctctttttggaaggctgaatagcatccccttgtgtgtctatatcgcgtctctttacttgttcatttatctgtggacattgaggttttttccacaccatggggaccgtgaataacgctgcagcgaacgtgagagtgcagatacctgtttgagatccggatttctattctttgaatatatcctcagaaatgggattgctgaatcctactgtagttccatttttaattctttaaggaatatccatattatttgtcacagcagcagtaccattttacattccaatcagcagtgtaccagggttcagatgtctccacaacctcacttgccatgtcagcctaagacacgctatcctcacaggccaggctgcagcctcctgatcagccctgcctcccagctgttgcccatgctgtgtccctctgaatgtctcctgcctatgaactccctgctcagcgttttgaatcatctccttctgcaagcttttctctccctccactgccccctctgcatcacagggactggcacgtaaatgcttttttatttggattgcctctcgctaaatcaataaacatagagtgcctactacatgtcaggccctggggattcagccacaaccagttccttccctcaaggagcctgcagtcccagtggggaagacaggcttttaaaaacgtggcagatcaaaagaacccaatctcaaaggattacatactgtataatcccatttatatcacattacataagtgaaaacattttaaaaatgtttaaagctgatggtcaccagtggttgcaagagtgagtgggaagaggagaacaggtgtggttatactggagcagcctggaggtcctgggggtgctgccctgctcagcaccttgttcagcatcagtcagtggtgatgattacacagacctacccaggtggcaaaacagtgcagaacttaatgcatacacagaagagcacaggtgaaaccaagaagcatgagtaaggtaggtggagcatttcaatatcagtgtcctggttgtgatactgtccagttgtctggtcagatgttaccctgagagaaaaccgagtgaagggtatgagacctctttgtattatctgttacaaatgcatgtgaatctatcattattccaaccaaaatttcaattttaaaaggtagcaggtcacccacatagaatataaacttaaattatttaaaattaaataaaatcaaaaattcaggtcttccagcttggtagacacatttccagtactcagggaccacccatggtggctgctgtgctgggcagcaccgaccattttcatcactgcagatcctgctgtcggccagcaatagtctatacctctctgggatgtgggttacacagttgagtgcgttcgtcaaaactcatggaatggtgaagttaagacctatgcatttcatttgtaaattttacctttaaaagtatcaaactcaacactacctaggcaaagtatttaggggtaaagtatactgatgtctgcaacttactttgaaacacatcgaagaataggatgaaagaagaagaaagaggatatagaggaagaggaggaggaagaggaagaaaagaaaaaagagggatggaaagatgcattgatgtgtgttaaagcaaatatagcaaatgttaactacagaatctagatgataggtatgcatgacttcattgtacaattctttcaacttttctatatcgagggaaaaaaacaacagagattcaaatgtgaccctatgaccatcaccctcccaccactgtccttctttttcacctgagccatatacaagcagtgaccttgaggcccctactggctgaggggacagaatcagagtcttgtgatcacatcagcactacttctcctctgcccaagaccataaccctgtccccagagagctaagtgaccacctactgcccctaccctccgcatgcccctcaacacacacacatacacgctgtcctggctccatttgctgctgtggcccctcgtgtcttctccagccttcttgcaggagccgcataccaatagtcgccatatcactcattcactcagtgagcacttaatgagcacttatgctgttccagacactgttccaggcactggagatgccttgacaaagcttccctgtggaagtttacattcatgctaaggtttgatgtcatacagattaccagaaaattccctgcttaaaagcagcataaatttaccctacagggtctgtaggtcagaagtgtgggcacagtgcagttcagcttgttctctgccctgagtttcacagagccaaagtcaaggcatcagccaggctgcactccttcctacaggctctgggggagaatgcatgcccaagcgctctcaggttcttgaccaaatgcaggtccttgtttgtgggactgaggttcttgtgtccttgctggcaatcaccagtggggtgaggggatgctcagatcctggaggccatccacattccttggcttgtggcccccttcaaagccactaatggcagggtgagtgcttttcttgcttccggtctctgtgaagtcccttctgcctcacctcccttctgcctcctcttctccctctctctctctctctctctctctctctctctctctaactccagccagagagctgtctccactctcgtgggctcatagaattgcactgggcccacacacaagatgcaagatcaatgccctattttacaatcagctggttattcaccttaatcccctctgcaaattccttcacagtaatgccagattagagtatgagttgaaaggcctcaggaatcttgggaggatgtcttcaccattctgctccccatagggaaacaaacgataaaccccagagcaaacacagacttcccagagcgggttaaggcaacagtcactttgtgggacttcacctcctactagattctaagtcagaatgaagcctttttcgggccatgcatcccagtgaggcctggtgcctggctctgggctctgagaaagctaacaccacagattccacataaatgaaatagtgtccagcacataaggtccatttcggtagattgaaagcattcaacactacgccgggttcattttgatcaggggcaagcagctcctaatcacctttattgtattttcagactcttggtttaagggtgttttgataaaggacagtgttagctggagtcagtgcttggcagtctaggtgctggggaaactggcagtgccagcccagggttggcgatctaggtacacacttaccccactgcttaatactcctctcagttgggctgagagaggaagtttttaaaaacatttaaaacaggtatgcccaagggctcaaaccctctacaggcccatgtgggaatgaatggccttgtgcctcaggtaacgagttcatctgcccttcaccacacctgctcccagcccagaagggtgtcgctgaggctgatcacccacctgcttaccccgaaggccctggaggacttctggcagtttccaaaaatcaaatccaagctcaaaaggacactgtgacattgtgaggtcagtggaaagggatatttaaaaggatatgccatggggcagtgacaggcattttggaagagaattttaggaatctgttaagcaatagtgtagcacggtgtaaggaggaaactcactcattgtacatatacttgtttaaacataatgggaaaaatctgttcactgaatgcatttaactcatcgaggcaatcactctaaagcatagcacacgtttatgcatcagtggttttctatttattggtttgttttttaggccacattactggggctacttagtattaagttcgacgatgaatgacagaacacagtgcccccacaaatgctgacttacatttatttctcttttgtaaaagtttggggatccaggcctttttggcctgccagtgtgagggactctggctccttccaacacaggattccactgtggatgcctcccttcccaagctctgcagatagtcccccttcaggtcggcagccagcctgcagggagagggaggagaggcagaggagggcgcacctgctctctgcaggacccttcagaacttgcacgaccacctctgctgccactacatgaatcccattggccagaacttagtcacctggtcacagctaggtcaaggaagtctgagaaatgcattgtacatttgggaaagccatagccctggctaaattcagggttttatttcttaagaataaggaaagaagagatcatgggagtgggtggggagatagtagtttctgctacagtccactcctttggccacccacagacctgtgtgagcctttcttcccatacacagaacatgctcatctcttgcccccaagagatacatctgcaaaattccatccaatcactgcatctgactctagatctggcaacccagggtaaagcacagtcctttctctgagatatgaatgaggattttaatggtttgacaaactacaaactaagtaataagttacttgctctcaatacatccaacataagggagatgagtaagaacagaagagctgtgactaaaactatcacttggtagttggaggctgataaacacagccatcatcatctacacacgtgagcaaatcccagtgggcaggaagagtggagtctccttctgtagcatcacccgccatggccatggccttgtgttctcagaggctcttccctactattatctcccctgccgtacccagtgtggggggcaaagggtatgcccttcctgaggctacacagcgttcacagtttgcttcttgctttgaaggttggttgttccaaccccccagaggaatcactttggggttaaacaatcacaagcttttgcagacagaccaaactgctggtttctttggtaaaacagtttttcaaaaacataaagacttcagatctacttgtttccggtgagctcttctgtgaagacacgtttttaatgctgaaacttctggtttttccttatgggcctccatgctctgctgatatttctctctctctctctctctctctctctccctctgtcagcataatggtacccacctggagccatgggaaggaagggcttagctgggaagacaaaacccttcaaatgacttttgacacaaggttccaaattggcaggatggggcactagttttattttctgctaagcaggctgctttgcagaaaccatttctacgactgatatagtttgtgaaacacagcagttgttttttcaaccctgcaaggctccaaattaccaagctctcagtcaacttaaattgcagactgcaggtagagtgcctccattagcacactgtgtttcctttcattcttgctcaggtactggccagcagtagccaaagtccagctctctcttgtagaacattgctaaaagcagtgataagcagctaatgcttttttttttttaacattataaatttctcctgccatttcctgcctcagtccttattcaggacatgggctgcttttcaaaaaacaatgggcagtggtttttatcaaatgctttgtttctgtataacaagggtcactggctctctagctcacaatatttgagcccctgccgcctgaacacatccattaagccaaggccacgtgcttcggttctgctacttgtagctcacttctcttggtctctattttgtatcagttaagattagacctggccatgaatgacagaaaatccaaaagagcaatggcttaaacaagacacatttaattcttcctcactttgagtctagaggaaggtggttcaggagtggagtagggctccctggtgcacaggcacctctgcctcttctatcctgcactacactgtgtatcagctctgacggcagtgaccagaatggctgccccacctccagccatcacattctaattccagccagtagaagaagagggaaacagacacatctccaccctcttcaaggacacttcctggaagttgcctcccattggccagaatttagtcacatagccatgcctagctgaagtggaggatgggaaatgttgctgccattctgcctggcaagtgcacagcaagaatcagggttcttttactggggaagaagaggtaacatgttttagggcaatcagcagtctctgcagcctcatacttgcacaaaatttcagcagtagaatgcttgtgttgggaacagtgaaaggactgttttcatggctccagaattctttatccttctccttcttcatagcagatttgtttggcctttgacacacaaatttcagagaagacaatgactagacaagggttgcagtctctgccacacagaaaaactctctgatgagaggaaaccatcttagaaacgccctctatttggcactgtcttgatatccttgacggctgccacaggtcatctttgaggggaccgttgctatgcctacttcacagaaacatacaatgaggtctcctcggtcagtgtttcacttgggaaaaggaaagttttaacaactgaggtatctgctgtgtttagtaaatcataaaagtaagcacaatgaacatcttagatgaaaagctccacaaaaccaatcagattgttattgcacataaaaaccaaaattgatgaaatgcaaaataaatatttaacttctcagactgccgctatctttggactgctgggtaatttggaggctaatgttcataataaaatcacattttctctgaaaatatttactatttctgtttattgccttattcattgccgttagcaagaattagtttaattcatgagtatatgtgaattccattacaagctaggaattttcaccaaaacctcctggtgctgatatttctaatggatgctttctttaagcatgtaggtagacttgagaatgaacttgggaggaggaccagcagacatccaggaatgtctcctgcagacatcagttggggaaggtgataatatataatatagacttgcatgtaaagggaaaggctgaaatatcctatgccaggggtacttcataaagatgccaacatgaccattttcttcactggacactataattccaagaccgaaaggcctatgaaaatagtcaggatatatatatatatatatatgtgtgtgtgtgtgtgtgtgtgtgtgtgtgtgtgtgtgtgtgtgtgtgtacagataaggatatcggcttcaaaatacacaaagaagacagcaaactaaaaattcataaatgtctaactaaatatctataaaacatgatattttgttacctcattaattgttaaatttgttgttcatgagtattgcatgaatattttattactattgaaaacaatttgtcagagagcatctcataatgcaggaattcacaaataagcaaaactgctgacattttgtagccagtagtaagctaaataagttacccatagtcaaaagcaaatttatttaaaacctttcaaaatttgtatggcaatgtgttcatttttaatgtaaggtatgaatacatcttaagatgtctgatatgatgtagaggttccaaatagaattccccagagaaggagtcaagcacactttttctatgaagagccagaaagtaaatatgaaggctttgtgggctgtggggtctctgttgcaattactcagctctgctgctggaacacaaagggagccatagataatacctaaacaaatgagcatggttgtgtgccaacaaagctttatttataagaacagacagtgtgctatatttgactcatggtagtaaggcaaatctagaaggtctaataaccacctattgcccttaccaacaattcagactcagaagtatatgtttctgggagtgacatcagcaagatggctgactagagatgtctggtgctctcccagacccccacgaagaaagaatcatggcaacaaataaataactaagctttaactggagtgttgaaaagagaatgctgtcatgcagcagaggaatggagaagtacctgtgacggctagaagcccaggagggcagtgtagaggcaccgtgcatctgcaccccatctcccctgcctggatctgatcagcccagagacaggagggactttccatttcaggaaaaaggtaagcagaagatcactaacagtccctattgccactgcaaacacctacagtccttacatacaagactcccacagtcctcacaaagccctgagcccagtttggagagctgcaaggatttcactgaactgcattgttccagattagtagcacaaggtgcttaccccccacattgtgagccaagctctcacccacacatacccacccactgtgagccaagctactgcaggacagcaccattctgagaccagagccacactctggagtgtgttatgctctggagatcagtcgcaactgtacctctacagcaccagcgctccatattcattccaccaagcccacatgagtgtctgaatgtcacaaccccagctgtgtagattccaggcccagagttagctgtgactcaggatgagcccaaaaaagaaacccacccttcaccgcccacatttccagtgggacaaacggccttgcagtcctgcccagggtgaacccactcttaagccagccaaaccactgcatgccctaccccaagtgggagaggtccctgaggcactaagcagctgatacatccccaggccagccgagaaaccatgtgcccccatctcaggccagaaaaatagccctgtgggctgctgcaggaagataccttccaggctggccaagaggccttgtgtccctgtcccaggcctgagaaatagccccatatgatgcccctggcaggcatgatcccaggtcagccaagcaattgtgtgtctgtgcccccagccagagtaataatcccacggtcccaactccagaaagccagaccacaagttggctcacccactgtgtgcacacatatgcccctgacctaagaaacaaaccaatgagcccacctctagcaaagctgcaccaccactgccataaactctctcagcccaggccactgagacaaacatcactagcatggattatagttgaagacactacatagagactacactactgtgtccacttagaatcaaagccaatgcaccccatcaaaccaacaccccaaaacccatctatatgaataagtttttccatatgaaacctactccataaaattagaagaggtgactgtttcaccagatatgtataaatcaatgcagggacacattaaacacaaaacaggcaaggaaacatgacacctccaaaggaacataataattctctagtaacagaccccaattataaggaaacacacaaaattccagtaaaagaattcaaaataataatcttaaggaaattcagtgagatataagagaatacaaatagacaattcaacaaaatcaaggagcaatttctgatatgtacatgaaattcaacaaaaaggtagatataattaaaaaggatcaagtggaaattctggaatggaagaattcagtgaatgaaattaaacaatataattgagagtttcaacaatggacaagaccaagcagaataataaatttctgaacttgaagacaagtcttttgaaataacaggcagacaaaaaaagaatgaagaaagactacaggatttatgggacaccattaagtgacaaatattcacattatgagtgttccagaaggagaagagaatggaaaaggtgtatgaaatatattttatggaataatacctggaaacatcccaattcctgttgaacagataggcactcagatccaggaagctcaaagaactccaaatagattcactccaaatagattctctccaagtcacattatagtcaaattgtcaaaagttaaaggcaaaggaataattttaaaaacagcaaaggaaaagcatcaagtcacatataatggaatccccattagactgcggatttctcagcagaaaccttacaagccaggagagaattggatgatatattcgaagtactgtaaacaaaacaaaacttgccagactataatattataccaagcaaagctatccttcagaaatgaaaaagtaaaatctttcacagacaagcaaaagttaagagaattcatcacaactattctgatcttacaagaaatgctcaggggagttttacatctagaagtgaaaagaaaataaccacaatcatgaaaacatgcaaaactataaaactcactggaaaagccaaaaacaaaggggaaaaaaagtaataaaagctcatcactacaggaaaccacccaactgcaaaaaaaaaaaaaaaaaaaaaaaaaaaaaaaaaaggcagtaagagaggaagtaagaaacagaggatatacaaaataacaacatggcaatcaataaatcaataaaatgacaggagtaagccctcacttatccataataaccttgaatcagattatattcctcatttaaaagataaagactggctggatgaattttaaaataacccaactatatgctgccttcaagaaactcacatcacctgtaaagacacacatagactgaacatgaaggggtggaaaagatattccacacagacagaaactaaaagtgagctggagtagctatacttatatcagacaaagcagactttaaagtcaaatgctgtaaaaagagacaagaaaaacattaaataataataaggggaacaggtcagcaagagaatataccaattataaataaacatgcacccaacactgaaccactagatctataaagcaaatattattagatctaaaggcagaaataagccccaatacaataatagttggggacttcaacatctcactctcagcactggacagattatttagatataaaatcaacaaggaaacatcagatttaaactgaacctaccaaatagacctagtagactttacagaacatttcactcaacagctacggaatacacatttttttcatcagcacatgtaactttctccaggagaggccatatgttaggatacaaaacaagcttcaaaaagtttttaaaaatcaaaattatataaagtatcttatctgaccacaagagaataaaactaaaaatcaagaacaagatgaacactcaaaactatacaaatacatggaaattaagctacatgctcctgatgaccaaggagtgagaaaatcaattaagaatgagattttaaaattccttgaggcaaataaaagtaggaaacacagcacaccaaaatctatggaacatagcaaaaacagtagtaagaggcaagtttaaagtaacaaatgactacattaaacaactagaaatatttcaaatgagcaatttaataatgtatcttaaggaactagaaattcaagaagaaatgaaacccaaaattagtagaaggaaagaaataataaagatcagagcacaaataaacaaaatcgagaccagaaaaacaatacaaaaggttaatgaaacaaaaagttgattttttgaaaaaataaatgaaatcaacaaaccattagctagactaagaaaacaagagaaaagattcaagtaaataaaattgaaacaaaaaattgagatgtcacaatagagaccacagaaatacaaagaattattaattactgtgaacaactatatgccggtaaatttgaaaacctagaggcaatggataaattcctgaacacatacaacctactaagattgatccaaaaagaaatagaaaacctcaattgaccaataacaagtaataagattgaatcaataataaaaattatctcaagaaaagaaagttcagggccggatggtttcactactgaattctgccaaactttaaagaagtattaataccaacttttctcagacaattccacaaaacaagtagagatagctcttcctttcttactctatgaggccagcataactctcattccaaagccatacaaagacacacagaaaaagaaaactacaggccaatatcaccaatgaacatagatgttaaaaccctcaacaaaaatattagcaaaccaaatccaaaaatatattaaaaagataaaagatcatggtcaagtggaatttatcccaggaatgcaaggctttcatatacccaaatcagtacacatgatacatcacatcaacaaaatgaaggacaaaaaccatatgattatctcaacggatgcagaaaaagcctctgataaaattcagtatcctttcatgagaaatcttttataccaaaaaattaggtataaaaggaaagtgcctcaacaaattaaggctatatatgacacacccacagctaacatcatactaaatgaggaaaagttggaaactattcccctaaggactggaacaagacaagggtgcccactctctcttcttgtattcaacataatactgaatgtcctagccagagcaataagacaagaggaagaaaaaaagggaattcaaattagaaaggaggaagtcaaattgtccctgtttgcagatgacataatctcatatatagaaaaacctaaagatgctaccaaaaactcttagaactgataaataaattcagcaaagttgctggagacaaaaatcaacatacataaatcagtagcatttctatacatgaacaacaaactagctgaaaaatcaagacagcaatcccttttacaataactacaaaaaactaaaatatcaaagaataagtttaaccatggaagtgaaaaccctctacaaaaaaagattacaaaatactgatgaaaaatcagaggatataaacaaatgtaaagacatttcatgcccatggatcagaagaattaatgttgtaaaattatcacactatgcaaagcaatctacagattcaatgcaatccctatcaaaacaccaatgacattcttcacagaaatagaaaaaaaaatcttaaaatttgtgtggaaccacagaaggtcctgaagagccaaaacaattctgagcacaaaagacaaagttacaaggatcacactatcagacttcaaaatatactacaaaactataataactgaaacagcatggtactataaaaacagacacatcaataaatgaaacagaatacagactcaagcaattaatacacatatctttagccaactgatttttgacaaaaagactacgaacattcattgaggaaaagatagtctttccaacaaatggtgctggggaaagtaggtatctatatgcagaagaatgaaactagactcccctctctcaccctatacagaaatcaactcaaagtggatcaaagacctaaatgtgagacccaaaactataagactattggaagaaaatctagggaaaatgcttcaggaaattggtcttgtaaaaaaacttatgagtaagacctcgaaagcatagacaacaaaagcaaaaataatcaaataggattatatcaaacgaaaaattttctgcacagcaaaggaaactacagagtgaaaagttaacgtacaaaatgggagaaaatatctgcaaactatttatccaataaggggttattatctggaatacacgaggagctcaaatatctcaacagcaaaataaaaagaatccaattttaaaatgggtaaatgatctgaacagatgtttctcaaaagacataaaatggccaaaaaatatatgaaaaactgcttaacatcatgaatggtcaggaaaaggcacatcaaacccacaatgaggtattatctcatcccagttaggatagctactatcaaagagtcaaaaatagccaatgctgggccagatgcagtggctcacacctttaatcccagcactttggtaggctgaggtgggcggatcacctgaggtcagtagatagagaccagcctggccaacatggcaaaaccccatctctactaaaaatacaaaaaattaactgggcgtggtggctcatgcctgaagtcccagctacttgggaggctgagacaggagaattgcttcaacccaggaagtggagaggttgcagtgagctgagattgcactactgcactccagcctgggcaataaagtgagactttgtctcaaacaaaatttttaattaaattaaataaagaaaagaaagcaaatgctggtgaggttgctgagtaaagggaacccatacgctgttggtaggaatgtaaattagtacaggcactttggagaagagtatggaggttcctcaaaaactctacaaatagaactacaatataattcaaaaatcctactactgggcatttgtccagaggaaaggaaatctgtattttgaagagacatctgcacctcatgtttattacaccactattcacaatagccaagatgtggaatcaacctagctgtccaaaggcagatgaatgcatgaagaaagcatggtatatatacacaatgaaatattattcagccactaaaataaaaaaattctgtcatttatggcaacatggatgaagctggaggacattatgttaagagaaataagccagctgcagaaagttgaaaatcacatgtcctcacacatatgtggaagctaaaaccaagtttatctcggaagtagaaggtagaacagaggacacagcagctgggaagggtggggggaaagagggatagggagagatttattaaaggatacaaaattacagcaaattattcctaggaggaatacgttctagcactctataccattatatgttgcctatagttaacaataatacatagttttagatagctagaagggggatggatattgaatgctccgtaccaatacaaagaaatgaaaaatgtttgagccaatgattacgttaaccaccctgatctgatcactgtaaatgtattgaaacatgactatgtaccccctaaatatgtacaattattatatgtcaattatttaaaatgaaataataaagttttaaaatgagataattttttaaaaatctacaggggacagaatgaaagaggcaagtataaggaggcaatcgaataaactaatgtttactttgttttgttgtccaaaaacatgtatttttcttaaaaaaaaaaatacttttatcctgaattacccagaaaatgccctagactgtcctctgagtcatgctaggatcagtacagctgttctacacattcaagcgtcccattcagacattccagtgctttaaatgtgatttttcttctttttcagcttcccaaagcagaggaagactgaggtaaccaggtaggaaaaggccagatctccttaaaaagaagtatttgcacagcttcttcaaaaagaaggagaaagttttaactctgagctgtaactcactgtttaacataatgcttcactgattcaccagcaaacatgtttctactgatttattttagggcatgagagacggcatttgctcattaattatataaaatttttatatggctgtagacttttagatatccaatatgtgcattaaagtgtccaaatagcattttaaactttgcttagtcagtctcttatctattactcagactagaaaactgactatttttagggcatatgtcccctattaagatttttaaaagaaaccatttcttcccctgaaactgacactagcagtaagtggacaagtaaaaaccaattaaattttgtggttttgtttaaagataaaatctaatcagaacttactcattcaaaggctcctaactcttttacttacataatacatacaagttaaattatgtcagctcttcattttttaaagagtatactgtttataaagctttcagcataatcatttttctcaagataacatattttatctatttatctaatcaaaaagtgaacagggaccaatacttattttttaaaaaatcacttcaaatactgactacaaatgttatagaaaaaatttctctatttacctaagttttcccttaaatggaagcagaatcataatcatagaaatgtaagtaacgttttcaaaatctatttttatttttcttcagtattacctgctgttcccaagtggctgggtaatctatgggttatattttcatttaccctcaaagctaggctgccagtggaagctaagaataacacaattaaattcaagtttctctagaaaatatgacaaatcaaattttaagaaagtgtaacttgtggttttgctttggttcaagatggctgatctgagaatatcaaagcatttaattcaaactaatagtgtgtcctcatcctaggactagaaggtaatttttcttttaaggagggaaaagaagagcaaaggggaaaaatccctgaatagtgattcccttccatgaattatttcaattctccaaaatagacttttttttttaggaaggaacacctgactctgaatatatttcctcaaacggagtcgcttttgaacccaaagagtccagcaaatcaggttgcaactcctgttccaagctggccagagagctgagggatggggcccctccacactccccttcctcgctgtagacgtgaggtaggtagccggggtcatcttccagcacattggcaacatggagtttctggggaaaagtgggggaaagagaaggtaaatgccatgtgcttccatacccagctcatttctctaggtttgattcgaggaacacatcaatgcagtagtaacagcactcaggccccgtgtcctcagctgacacaggagttcgtacagttccagaagtggcagccatgctgaggggagacatcccaccttacagtctgagagggaactgtgacacagtggtggccgccccaggagtatgacaggagcccccaggaggacctcccacctgctcccaccctcttgcagattcattccttgaggctcgcccttccctgtcctgtgccctggacacctccccttccatgaccccccggccctcgtttggacaactgtcccctctctcttcatctttacctggcctcttgctgtgggctcctttctcccgacccacaaatgtgctcaggtctatccttcaatctgctcatacttcacagcctccctgcaagaaagggcggccaccacttcctgccacccctttctcacccatgtggctcctcaaaccactgccctccagtctccccattcatgctcaggccatggcttcatccatccctaaccaatggtgatgtccccgtcaccatctctctctgtgacactccctacagtcacatccagagccagaattccaaccagacagctccacaaggacatccacagagacctcagactcaacatcctggaaaccactgtggttttgcccacaacctacatctcctcctcccacgtccctccctcaatgctcgccaagtgcagtgcgcaccccctgttacaggggctagccggctacaagccaggggataatccagcacaccacctgttgttgtaaattaagttctactggagcacggccaagaccgtttatttgtgtatcatctgtggctgctttcacggaacaatggcagggctgagctgtgggaactggccttcaaatcctacaggatttactatctggccctttataggaagttcactgacccctgcatcattagatgatttcgatggtatcagaacacatatttatttgagtgaatggccattttatcgtatatttcaaaacacaataacaagcacgccaaatccatgatttcacactagctgattgtaaagccaaaagctaattaacatgtgagctgatttacagaaatgcattaaatacatcatagtgagtgggttaaacacaagcgtgacagtagtgacagaatgaccaaagttcatgaaactctagcctgacttaagtcaggacatcccctacagcccagctgctcaaccttgaaacctagagtcatcaccaactctcccctgccccatcctctcaaatgctcggcagtatttctagttctgtcccctctcctccagccccatggccaatgcctgaggataggtccctatctccactcattggggcgagagtggcaagttcactaaactcatttcttgttcttctggtcacccggcaagatcacatttcctgcctctctgctagatgtggctacgtgactgatgaaatagggatgtcagggacacgtacctggccatgaaagcctccccaagagcctctgttctttctctgtcctccagccccatttccagttctgagtggtggcagagccacagagtgggaggaccctgggcaggctccggctcgacacccaccctgatgtgtgacgtgagccagaggtgcctgctctgcgcattaagccaccctgctctggggttgccatggctttctccctccaaacagccctcttctcaccatctcctcctctccccaacctctcctgccttaggtccaccctctgcacaaaccccagaaacatttcctaggcttcatatctgctcattcctgtctgcctagaatcctagacagccctcctctgccaatctccaacccagcaaactccagctcagcattcaggacccaagtcatctctctgtgaagacttttctggcctgagtgattcaataaataggggagtggaggggaggggaggggagagggactttagcctatttaccttctaatacctctagagggtgctatctgaacccagcgccagttctacagaccttggcaggaatgggtttagtgggagcctgtctaatccgtcactgctgatagtaattctgagagggtgagctcatgtagggcatgaaaacagtcagaatcctggggctcaagcccaaggtgggaggtggggagggcctggaaagggcagctctggggccccagggaccccatgcgtgtccccattctgatgggacccctgggcttccaagctcttaactatgccccccgccccgccccacccagtgactgcaacaagctgtctccagcttcctctggttctcaggagccctgcctgggcccttgtttagtgggaaatgctgtctccccgccccagtctactgctatgtcaggcttggtgcccacgagaagcgcgggaatgctcacctgcacatctggcccattgactgggtctgcttactcagggactgtggtcactgtctgaccatatggcatgggggagctgggggcagggggaggaaagaaagtttttacggcaaaaccagcagatacacaagctctggcctacgtgttaggagtcggttcacgtccttgcagtgaagctgaatagataattagcgacagacctggtgtgtgcagagcaaaacagaatctgcagtgggggctgtgctgggtggattcaacttcaaaacccccaggctgacagcagagcagtggatgtctgcaccctgattcagcaactttggaggcctcatcagatcaataattcatcatacaccaccatccaagttagagggctcacaaggaaagaacagggccctctaatctggtgttccctcctctcacaccaccaagcagagcttcgagcttccattgaataaagctgcctccctgccccgcagagggaggaggggggcccgcggctggaacacgtccctctcctgctcagccaggcaggacctgcgatactgtccacacagtccacttggcatgagcggtatgtgtgcatgtgcatgcgttcacgtgtgtgtgcgcaaatgtgaaaatgggtaagctggatactacgtgatgatcaccacatgctacgttttctgtagagacatgatctggtctgcacagagcttcacccgagagtgtagcagagctgccccaactctcctttgtagatgagaaattaaggctcagagaggagacttccctgaccctgcttaatgatcaggtgggcccgtctgtagtcggccactctgtgccccatttctggctctgtccctcgtgcctttaccattggagcaacttgtctgagcctccatttttggattcatctaccacattgggttatagtgaaaatggttctttcattgcttcttcagtgacccctgtgtcatgcaccagtaatgacacagcctggccctcagggaggttacagtcggctcgggagagacacatggaaatttccccgcagctcatccttcatcttcctcaccagcagtcaggacctggggaagggccctgcagccctgagtctgtgggtacacagcccccttctgcaggagcctggcttgcctgcttttaggcaaagcttctaggcccggagaagatgtctgtgttgtcttgaagcaggtgccaggcagcacccattctgcagggctaaggagtgggagtgagaaggggccaagcctacagcacctttggggctgtcactggggcacagagctggagctcccacctggggactgtgacaggaaccagaggaagcaacattggggaaaccccagacagtgactctacatccagacacagtctgggctcacttcctcaggccacagtgttcacagccctgtctgtcatccactctgacaaccacagcaggagacgtccaggctcaccaatgggtttcacaaaacaggatcccaggacctcaagtcagaggctcagatgcgcaccccagacccactacagcagggtccacagagttggtactggggattgctgctttttaatgagccccctaagtgcctagaccctggagcccagttgcctgtatttgagccccaaatctactgctttctgtggctgtgaccttggacacattacccaacttctttgttcctgggtttccacatgttataaaaaggcatatgacagcacctcccccaataggctgatgtgcagactaagagttaacatctttcaagtcctcagaacagagtctacaacaaagtgagtattatacacgtgtttgccaaaaaaataagtctggcctgacagagactgtctacatttatgtcttcctttgtgcttatcattccataggcctgagttcccactgccctgcaacaggaggagctgcttagagtcagaatggcctgggcagcttcttggtacctccttccccaagcagggggcatgcagagcctccatgacacgagcatgtggactggctctgccctatccatgtaaacctgcccatgggtttgcccagctcccaagctgctttctaatcttcccaggagtacgcagtggctgtgttgatggacctttcaggatgtacccaaaatcagaatctcacataatagaccccttcagcgcagtcaaactacatctttcacaattttgcaggaaaagacccttcattctgaggtaggaggccagcaggtcttgttttctggtcacaaccctgctgaccaaaacaggatctggtccagatgggatgaagttaaaaaaaaaaaaccagcagaaaccagcagatgagacgaaagtgaaccctggatgccctcattgctcactggtgcaagagactcacaccagtgccaggacagcttacaaatgccatggcagtgacccagaagttatcactgctgtcctagaaagttctaaataaccagcccctccgtttgcatcaacctgctgcttaatttgcatgtaattgaaagtgggttttagtgggtataaatacagttgccaacagcccatacatttctgactctgagtgtactgcctatgagttagccctgccttgcaaggagcagtaatgttgaatagaagactgctgtctaacacctccacctcacctttgaattatttcccaaaaccctcctgggctaatccccagttttggggcttgcctgtgctgtgtcaattctgtcttcagttgggttctgcaaagcagcactggatggaggatttccatgaaagtgattgctatggacttaattgtgttccctctccaaatccatatgttcaggccctaaccccaatgtgatggcatttgaagacggagcctttgggagacaattaggtttagatgagctcatgagggtagagtcctcatgatggaattagttccctaataagaagagataccagggagcttggtatctctctctccatcccatgtgaggacacggcgggaaagtggccatctgccagctagcaagagagctctcaccagaacccaaccatgctggaaccctgaccttggacttctagcctgcagaaacatgaggcaatatatttctgttatttaagccaccagtcaggctatggtattttattatggcagccttagctgactaatgcagtgatttaggaggaagtgtccccaaatcaagcctggagcacagtggggatgcaaaacccatagctagtgcacagcacaaggggagctctccctacctgattcaatgtctctgccatccttccttccaccggagccaggagttgtctgtgcattgtggcatctgggtaagcctgcaagcaaaccagtagagcttcataccacagcagagcccttgtcctaccccccaacccctgtgtgtcagtggccccagcatagatggggcacactgagcaccgttctcttggaggtgaagagccaggcccagggtagtttgctcacgtttcctctctttgtgttgggggagagagggaggccctgcaagctctcatggctagactttccaatgcctgggctgaaacaaactttcagtgaggaaggaacccaagtgagcccggccaggagggttgttcctgctgacaccctcactcatgccttgcaccccctcaactacactgcccctcctcgctcattttggcttctcttcctctgaacctgcccattgtttcccatgatgggctgctggcagtctcctgctcatctggcccatgtctgtggatctgggtctctgtgctatctaagggcagaggatacagtggtaggaaacaggcttggcatctactggaaggagtggctatctgggggctcacaaatcccaccactaaatcatgtgagtcaggctggcctggaggcaagcaaagcacctggggcctcactgtcgagctcacgcaggtgcaaggcaagcacccaagagtggcggtaaatgtaagactgatcaccaagggaaggtttaagaggggatctcacccagttgagagcagggagttctcaggaggaggaagttgtagggccatggaacagaagggaattccaatgagaagaaacagcacaggccctaagcagggagggaacttggcgtgttctgtggctggagcccaaagaggtggggtgctgggatggttagggaggtggggggaggctcagagcaagttgaagccatacgtgagcaaaggccatgtgatagagggtctcacaggacattaaagacataggtctgtcttaggctgggttctgcaaagcagccctggagggaggatccccttaaggtcataaggttgtagactttatcccaggtgcaatggcaagccaacaggaagtcttaaattggagagtgacatacaatttgtgtttttaatcactggtggcctttatggctgagatgacttctgatcttacctgggtttagggatacttattgggttccagaagacatatgtaaaatatgataaagcctggggcaattatgtatgtccatgaggctatatatacacatacatacatacatacatacatacatacatacatacagatatatacacatgcacatatacagacaaacatacacatgttcatatatgcatactcatgcctctgtacatgtacatgcttctatacatatacatatagacatatagacatatacatatacagttgacccttgaacaatgtgggggttaggggtgctgaccctgcacagttgaaaacatgcctataacttttgattccccgaaaactcaactaacagtctactgttgactggaagcttttccaataatataaacagtcaattaatgcacattttgtatgtcatatgtattatatactatattataacaaagtaagctagaagaaagaaaatgtcattaaggaaaatatattcactattcattaagtagaagtggattatcataaaggtcttcatcttcattgtcttctctctgagtagaatgaagaggaggagggagaagaagggttggtcttgctgtctcgggggtggcagaggcagaagaaaacccacatataagtgcacccacacagttcaaactcctattgttcaagggtcaactgaatacacatatctatctatatacacatgcatacatacagttatgcacggcataacatttcaatgacaggccgtatatataaagctggtcccataagactgtaatgctgtatttttactgtaccttttctatgtgtaggtgtttttttcttttcttttttttttttttttttttgagatggagtctcgctctgtcacccaggctggagtgcagtggcgcgatcttggctcactgcaagcgccgcctcccaggttcatgccattctcctgcctcagcctcccaagtagctggggctacaggcgcccgccaccacgtccagttaattttttgtatttttagtaaagacagggtttcaccatgttagccaggatggtctctatctcctgatctcgtgatacgcctgcctcggcctcccaaagtgctgggattacagacgtgagccacggcgccctggcctgtgtaggtagatacacaaacaccattgtgttccaattgcctacagtattcagtacagtcacatgctgtacgggtttgtagcctagaagcaacaggctacaccaagaggtctaggtgtgtagtaggctacaccatttaggtttgtgtaaaacactttatgaagtttacacagtgatgaaatcacctaacaacacatttctcagaacgtatccccatcattaagccagacatgactgtacatatacacatgtgtgtacacatagtgaagccacatcataccaaggtaagctgaaccaaacatactaagccaaagaggcaaggtgtggaccactacaagcagccctagggaccctgctgcctggttcccagtgctgggagcacttgactggagatgctgtgccctcagtctgtttagccccaggggcctctcagaggaggacccttaagatgtgggctatgtacaaagtacccttgcaccagatgctcactgaccaagcatggggctcatccaggaccagaggaagacgccgtgtcagtttccagcctggctccttcccgaggtagacttggggtgattttgcctcaagccagcttcaggtcctaaccccacactatgtatggctgcactgtggctgagagagcactatctctcctctctgggcttctgtggacttagccactggtttaactctatccccagggcctacgactcctcaaagatacttcagctagagtatttgaaatttattttcattatttacaaattatttcaataacaatattgaatattatttttataatataacagaaagtggtttacatcttttttagtctcccacaccaacatgtaaatttgggatgccatgttaattagcttttatgcaactcaaatgaagcttttggtcccatgtttcattaatcaaagagaatcctaacattgtaaactgagctattcaaaaaccattaagatttgaaactgcttgttggtatatatcaaaattttcttgatactttaaaaaccagtttataataatgcgaggcaatgaattaggtgttaagttaacataattttgcaaactatatccacaacattcaacttccttctgtttacatcagaatcattatttttattggctattttggtaataggtatatgtcattaatgtcaatgcatacaaaattagtacttagatgttttatttacaatggagttatttgtaggatctcatttgaaaagaagaattctggtgcaaaacatatttagaaaaaaaaattgactagatgatgtctaagacccccttagctcaaaatttctataggtctgtgacaaagcacagcagaaaactcagcctatgactgaggtcttagcaactcaacagcaaaagaaatttgccagggactgaaaagctcttatgccctcgagtcacgggataaatgtgccttaactacttccaacctctcttcacgttcgcttctccttcagtttgcttggatgttgggcatatttttttttatcacctctttccttccaaatttccaattttcagggatttgcacagcttttaggcagaacaataaggtaaatttgttcacggtaacacctacatctatacttacaggagtagagtgtatgtttttcacacttcttggctcaaagggcttgccataacccttaaagaaagatgaaatatttactgatttcaaataaattaccaaaggatgcaaatacataactagaaattcttgcagtcatattgcctttcatttttgtactaaaggtatagtaattctaaagagtgtagatattcatagcagaaattcatgaacaagtttcacagttgctttgtgaagaaggaacatgagaatattagatttgcaagctctatcttgggtccattaacacccagtaagatttccttttgccatggccatgccctgaatacaaacaaatgacacacatccactcctaggacccaggcctagcggcacaactctcagggctcagtgcaagatgaaagttgggggccctttgttcaaaaattaagaatttcaagatggtgacagtagaatattaaaccaagcagaggttctttagagtgggaggccctgtgccatggtgggtgttccatgtccatgcagctggcccgaacaggaccagaaggatcagctgcaaggacatggaacccaacattcatcaatgcgggagcccttcagtgatggatttgtggcatcatctttgtgcaaagaagaacatcatgttttcatctttgctcagatactgcctgtgcaaagatatgaaattatagagatcttgaatttattttagaagctttccctcataaaaattggatatgattctatggctctttagaccctgaatacctcttttaattctatatcagaaaagtacattttggttaaataatggctagttaaactggtgaggtccaaataaggtctgtgactgagaactgtactcacagtgttgtgccaaagcccattttctgatttgatcatggagtagggttacataagatggtatatttgggggacccccaagaactctccaaactatttttgcaacttctatttagtctaaaattatttcagaaaaagtcatttcacaaagcaatagtcctggaatttgtatgtagagtacaagaagacacaacacagatgggaagtcaggcctccctttcgctggaagcatgcagtcactgggctggaatttagtcagggccaaagtgctgtgcttttaactttatagatgatctctggtgcccttagaaggacatgagaaaatgtatctatttgtggatgctctaaaaagtgtcatatttgatcaggattatcaaacaactctaaaaacagcagccatcaccaataataatacctagttctatagatggaaatagagtcgggtggaaaaagcccagcttctcagattttcattgactatgtgcctttttctgacagtatcaccgaatcttctacaacggccctctctcagggggaccaactgttagtcactagtgagatggccgtagcagggagcaaccttctggaactcacccagctccccagagcacagcgtgcttgggctgactgactcgctgcagatggaggcacttcctcgagatcctagagggaaaatgctgatttactcaaaagagaatggatttctctccagctggaaacaaagtgggcatgcgtgacctctcaccacttccccttgctcatatattcataggcaaacacaaattaacacgatgagagggagggcgcggtgggaggaaaaggaaaatgaagagaggcagggaatgcagggataaaagggcaggcacaatggaaccgcatggcaggaggaggtttgaacatgaagacgctaatgttctttccatgacacagacacctgaaaactgcatagacacgcagatgacatctagaaggtgacactcacaggtgaaactgtttagattcagggatgggattgtgggcattttctgccttgggtttctgttattttaatagtgacgcttcaataatgaagttatatttcaaagaaaataaagcaggcaatggaccttgacaatggtctcattgacgctatttcacactatccagcagattttaaagtatcaggttaccccataaatcataagtgacggcttcacttagagaaagtgtgtgaatggcagtttatttaagcagtcaccagagatgtacttactacaatatttgcaggacactgaagggaacccagagatacaccaaaacctagaaggtggaggctttggttccctcccctgtaaaatagggaagcaagattgcccctaccacacacacgcccctatgggttctggtgaaaattcaataagatgaggcatgcaaagtgcatagtgtgcccctcagggcaacacctagacctctagaagtttgcagactggctcagaggaaggaaagagaaggctctcgccagcccaggaggcaagtttgtaggaactagaaaagggcagcccttcccccaggagcacagactagtggtcagaatgcacggcgaacccagccctcctcactgccctggccaggcacatgctcatttatggcaatcctgggtcaactttgttttcaaagtaggggacacctactagttatagaatggaagatttagctacttgggaaacaattttaaataacactgatttgcacggtgagaaaattattccctttctaattctgtttccacacccttatgacatccaggaggaagtgtcactctggtgctagcctggcttccacgctctgccttccttgcagaggggccccgggcctttggcagtgccatcgtccacccagtcattgtgccctacttctttcatggctatcttcacacttgcctgctctttatacaagtaaaactgttttcatttacagttgaaatataaaatttcctacttaaataaatgtacttaatgtggacacaagcccattttaagaaaaaagtgtcttaagaaatacactagtccaagtgccatatgcatatggcaaaaaatcaccatatggcactggacacagtgatatttggaagcacagggtcatctgacaccgcagcaaagtagaaagaacttggccactgaaagacaagggtgttttaggctaagggaaccatggggctttgcaagtaggggctggggttgctgacttgaagaagaacctccctggatgtggcactgggaggagcatcccaggtgttccttgtcagggaaaccaccaggaaagtcacttctctgaaatccagaagcaagtaaggggcatgttaccttaactccctgcgtgggtcctgctgcagctgtgcagatgagcagagccggcctctggccttcaacatctgaccatgtctgtagaacacagagaaagaaatatgacaagggctgaaatcacagatagcagaaataaaaacagaaggaaaggaatgacattttctccaaaacacattgtatctatgccatcacagaagaagtccagactgtaaaaaatacacctctcctgtaaatctggatgacttatgtgggaaaagaatgttatttctgtttgccttttgtaattgctcgctgggaggttgagcttctcatggttcagggttccatgtaaactgatggtaaaaggctcatttcaggagctctcagaattgaaaagcttgtcttttcctagggctcatggtgatggctcttggggtcaccagcattgcatggtattctgtgcattgtcccattcatttatcactcaacatatatgttcactgagggactcaggttgatgggtgctggatttctgttggccaagggctcattagcttccccacatgcagggaaggcatctatgcatttctgtagatcatcaccatcagatggcatccctatagtttagtagtagaatgtgacaacatgtgtgcagctagtgacgatatcttgcatggagttttcccaagagcacagaatgttcctggtgagtggatgtgcaaggtaagctggtatattcatgtaagatggacagagggataagtgcacctagagatggccttatttaccaaggttacagagatataatcagtaattactgctaataatgctaatattggcggccaccctttattgcatgactcttagtgctgaaaattttacatgtgttatttgattagagtccaaaaaacttaagagacagaagactatcaagctcactttatatatgaaagtcagattcagttagattatgtaactgatcaatcacagatttggaatctacacccaggtctgttgaattccacttctcagagccctaagatactgaagcaggaatggagatgtgcctttagctgtgaatgggaaacaagagaaagatttgttggtacaagaagagaacagagccccttgcccagcatgaggttctcttgtcccactggcatagctggtctttgaccagtgccaccatgtcattaagccccctccaaccctcctggtcttagcatcacaagggccaaggttcctttccacccacactgcttccatagctgcttcctcttttccaagagacaatcacaaagctgctgggaaagaagggtaaccagggcatccccactgtcccttccacctcagctacaacctgaactcaggttgtgtgacattcctgccagtctcctccaagctcagcagctttcactctctccctccaaggaggagactgaggcacagctcctgggactgggaaccatttctgtttcccttcatggttgagcctctgagccactggaactgtccaaggcaagaaattctactgttacacaaagactgctgtttgtccagatggttttcttcttaaaattacacaacaaatcaagtttactgctgctctcacatttgggatgcggagattccttccaggggacttcacaatctggagagtttggatcttgctcctgtttccccacccaggaagggctcacaggagggtgcacaggcacatacctgccagaggagcctaagtggctgctcccttccctccttcatgccgcagggaagacaaaattcaaagaaccctgggagccttgggcgagcaccagcttcttcaatcaaatatttttgagaaactctctaattacaggagcatcatatcaagttcattggaatatcttttccctaaatgtctgacttcattcaataagtctctcccttccaggaaaaaaacattggtggaggtgtaagatggggtgaccgaatcctctgtgtgtgtttccttttgacatttcttttgtgttcattttctaaatcaaccacttaattctagatgaagacaaacaggagagctcacaatgctttcatctctttgtctgtctaaccccagcccagggttgctgcaaggatgactaagataatgtagggcccatttcagaagcagccagtttgaaaaaccagtggccattggccaattactttatatggctctgccttgtgttaggtgccttcataggcatcctctctgatccacaacctatctaagaatttgactttatcatcccagttcacagatgaggatgtagggttaaatgatgaagctaatgagatgcaaaagcagaaacagagcctaggccttgtacctccaagggcagtgagctttctggttggcctttgccggacaatggtagaagagcaggttctgccatgatctactgaaagccatggccaagaagccagctcagactcatttaactagtgagcctaacacaatcccatttagggaacgtctacttaataaaaaacactatttccctaagcacagtttctcaaactcagcacttaggaaactggggcagataattctctgtggtagaggctgtcttgtgcgttgtaggctgtttagcagcatctctgacctcaacgcactagatgccagtagcactcctaactgtgaccatcaaaactgtctccaggcattgatgaatatctcctatggggcaaaattgctcatggttgagaaccattgatctaaaagaataaattcatttatctgagttagatagtatttgcaagaattttttcccacttgctactgaaacacgggtaagagtgaagaattaagaggtggcacaatggggggaaaaatacatgctatatgtctgtgtattagtgaattccttgccataagacacaaagcatgacattccactacctgggctgaagtgcctttgctctccgcattatacatgaccagtgtttggtggccttcatcattggatacagagcatccatgcctcttaggttcaagcacaaaatagcatcgcaacagaaaaagcagagccactgttataagacaaaggggaaaaacagattagacaagctcacccatatcagaggtttcatgaggatcttgttctgttcatgtataactcagtcatgaactggcaaggccaaattgcgtcttagtcatctgtgtagctataaagttcagcacagttccagggtaccagtagatgctacataactgtttgttgaattaatcaataatactatctggccagtaatattgtattgtttcttggaaaagctgctttcttattagccttgccaagtccaggagcctgaatatctgtacattgctgtctccatggttattacaaacaaagggccactccttgactatatttaccagtggattccattgtgagtagaagctgcttttgctggccagggatcttgcctggccagcatggcaacctctgatctacatctaggagcctgagtacacccagaagtcattctcaaagccattccaccaatcctgccaccgctgtcccctaccccagcaagccccttacccctggcctattgcctggggagaggagccacagtcccaggacacccctacagaccactgacctgccagagccacaaatgctgcacagacagggaacagggcccccacatgaagccccacttctgcatctgcaagctccacacatgtgagcccactggcacaggggcagatccttacatggacagtttgcttctgggaaagtccctgtttgtctccaatgaagagtggcaccaagtaattaccacgtggcaggcttctcaaggttaaaagttcaactgattgacctgcaaagggaaaaagaacatggcatgcattgactcactcatctgctcatctgctcaacacacgcttactgaacgccctgcacgggccaagctctgtatgaaagtaagccaactgcagagttagagggaggggtcctcaagggtaccctcacttctgacatcaactgcaagttcacggattcctaagaccaccctcaggttcaacaattctctagaaagactcacagaacacactgaaagttgttacagtgatggtgccgttttttacagggaaaagatacagacgtaaatcacacaaggaaagaggcacctagggcagagtccagaaaagcaccagtagcagagcttctcatcatccactcccgagaagccaggtcagcatcgatgagggacagcacacatgggatgctgcagtcagggacgttcacctgagcctcaggctccagtgtcctcctggggcttggtcaggcaacctggtgggcctcccaggtgggcggcctcagtctccagcctctctggtaatagactgatactatgtgaccagaagtccccagtgtaaatcacattgcccctatccggctcagcccaagacaccccaggtaaagagacactggtgtcagacatgataccccaatagagatcacccagaccccaaggacaaagaccagacctctctttgggcaaggcgaagtgctttaccacacactccaggtctgagaactacaaacttgagcacacagtttcagctgaaaccgtgccacagtctacagacgccacggctagaggcacagaagagagtgttgacagtggatgccagttgcttttaacctgctcagcatgttcatcttctggtaacagtgccccagtgtttccttagggaagcccacacttcctgaattctcagtatgaatcaggagagggtgagcccagatcccaacaaggtccaggtgtgggctgggaaccagccaatcagcacatccgccctcccaagtcccacccacagtgattgacagggcagctgacccaggccaaacagtgacgtcaatcctggagcttccctggaaacacccttcttgccagatgcaagaatatgtctcagggactcccagcagcctcctaccccctgatgaggagagtttcctaaaaaagaaggaacctagagaaaggcagaccatgtgtgggaaggatatccagggatatcctttgagcacctagagccagctctgccagaacgcagacctctccggttttttaagctaataaagtccttttttgcctaaatctgtttgaattggatatctggcattttccactctttgcccgtaaccaatacaaaaactcaccccaatttctccccaacttccatgtgtcctccgcatttccccaggtattgtccaattcaaatgtaaatgggtcagagaacggctccaggtccggatcctctgcctcgatgtggaggggctcatgcacagcagactcacagacctccatgtagcgggaacgtggccggagagtcgggacgttgtcattgatgtcagacaggaagagcattagggtccctgtagcagtctgcggtgggaagccttgtatggggaggaagtttcaggagttgtttatctcgtgcacacacagctctggagaatgagcactctccgtctctcagaaaaaaaatattcctgaaatactggaactgtttccctttcaacgtcataagctctcctggcatgcacgtgatctgttttcctgcttttatgagcattcagaatatttgggtaagctaataaagcacttaccacctcaaatcacttgtagaacaaggtagaatgtggcttcattaaaaaaacaaaaggtcaatcaatggtgccaggcatcaaggatgggtggggtggaggaaaatgggtgtgactaaagaagggcaccatgggggtccccaaggggaggcaaatgcgctgcgtctccgcgttgatgtactggttacaaggttacactgtagtcctgcaaggtgttgcccctggggaaaactggcaaaggatactcaggatccactagattatttcttaaaactgcaagtgaatctacaattatctaaaacgactttttctaattcaaaaaagtggcaatcatcacttcataactgcaaatatatggagccaacctaaatgcccatcgaccaatgagtggataaagaaaatgtggcatatgtatactatggaatactactcagccataaaaaagaatgaaatcatgtttttttgcagacacttgaatagagctggaggccattcttctaagtgaataactcaggaatagaaaatcaaatactgtatgttctcacttataagtgggagctaagctatggatacacaaaggcatgagtgatatcatgaactctggagacccagaagcaggggaggagggagccaagggctaagaaatctcacattggatacaaggtactctactcaggtgaccagtgcactaaaatcttagacttcaccactgcataattcatctacgtaaccaaaaaccacttgtaccccaaaagcttttgaaatacaaaaagcaaaaaataaaggaaaaaaaaagtaccaatcataaaatcatccataacagaatgacggaaccctgaaacactggccccattttttctcctcccttaatgctgattaggaacacgtgtttcatatctccattgccccccgccaacattccactagttaattacagaatggaacgtatagtgatatatcacttggagcttgggttttagttcacagactttcttaaatacaattttaaagttatttgaacatttttatttcttcaactctgctttggtgtgtttaaagtttcagccttaggagagtgtagagaaaaatgctgaaacaggcttataaaaccacccattctggtttatgacaaatgtgtcccttacagtcccatttatctgagctcgtatgccatcccaagcacagggaagctgtgctaaatatttatcacacatcattggctttgacaaagagctaaagagttagctcatgaacagatgaaaaagatgctgggtttgattgcagcctccttgctggtttaattgtctcttctgaatgaatactgccctctttcgatggtattggtcccttgtttaccattttaagaattattaccaaaaataatcaccagcatggatgcagagtgataacaaggtttattttatccttttctctgctgtgctgaaagacgctcaccagggttattttcccgcaggaagcaagaatgagcattttatttttccaattttgggtaaacactcaccatcatcaacagcgtgaatgatgattacataaaaactgttatttacatgaggggattctcggtcaattggctccacggtgatgaccactccggagtttttgtcgacgctgacccaatttgctgggtcatgaaccagttcatatcttgtagaaggaaaacggacagcaatttttaaaattaaaaacttacattaaaagataaaaaagttgcataaaaaaacaaaatatgtcatagaaacactatttctaccacaagtaatttgagaaattctaagagcaattaaactacgagagtgtttaattcacgaaaggaatggaagcacagggaggacagcctaaagactctcctaggtctgtggaattgacattcaccagaagaccaagcgtccccctccttgttggactgaacatagttttgtctgccttggggagatgattcatcctggaaaggaacccatcttcagtggcctgtagatgatgttagcttagtgtgaaaaaccaacctgcccttgcaacagaaacctaggactttacccctggtgtgttccctttgcagcagagccctggcagttcacagttgggtaaccctattcctcaaagtggtcttctacatccccctcacctatgtgaacctgacaccactgtaaggggtgggccacgccaagccctccagcattcctgagagctgtcagccattggattgcatcctttgcaaccttgccaggttgccaccccagctacctgttgagggcaccgcagcaggaacctcctggactcaggcaaacaacaacaacaacaaaaagtgcaggtcccagaaaggtgcggagaggggcagtttctccttatgcttttccttcatcttctgggcaaatgtttttcaaagggtcagcaaggatccctctctcatgttgcgtgggtcacagtttttaaagggattgaagctttttgtgcactgcttcacctcttagggaaagttccagaagttccttagaagcactgtgattttgcaatgtttacaaacgaggggaagaaactcagagttcctctgtggattatctcaggccaaaaggcagctccctcagctaatgcagatgaagcagaactagaggaaaccaaagctgcccccaacccagatcatgcctccaccctgtcacaaaagacactcatcctgcctcctggaaaaagccatattgaggctaaaatgatggactgttagttcttgatttcagcacagtccaaacatttcctgagacctaagtatgagccaaccatcctcaagagacaggaagacagcaatgaattaggaaaggctcctgttggtggtgcctaaagggatccccagccagcatcatgggcacccttgggagcttcttagaaatgcaaatctcagtcctgaccccagacctctcaatcaaattctatgggtgggttggaaaccagcctggccaacatggcaaaaccccgtctctactaaaattacaaaaattagccagacgtggcagcatgtgcctgtagtcccagctactcaggaggctgaggcaggagaatcacaagaacctgggaggtggaggttgcagtgagtcaagattatgccactgcactccagcgtgggtgaaagagagagactccatctcaaaaaaaagaaaaaaaaaaaagaaaagaaattgtaggggtggggcccagcaatctgcattttaacaagttcccccagagactgatacacactatagtttgacagctacttcttaagagccttgctaactcaaggtgcaccactgtgcaccagaaggggtctgtgagctgttggttggctgctcacaatgagataactgcaaaaatgaagagcaagtgttgagaagcccttagagtcatcagcattgtcatgtccacctagtgcatgaaaatttttctagtaattccatttcattatattttgcaaacttatcactccataatgaattgtaaatttttaaaaaatctagccattcccaacagataagttgagaagtgttgctgtaaggagaggaatctcacactgaagtgtggaccaaggccaagtaagcacgagaaatgagtgaagctggtggaatggggtctggggccaactgctgagctcagcctggagagagaaggggcatgactcatgacccctttctgtccccatgatcatggtctcatggaacatagacccaaaaatgccaatttcttccatttcttcaagaacatcaagagattcaggccatatgccacccaagtgcccatcgatggatgagtgggtaaacaaaaatgtgtcaataccacatatgcatattcagcatcagaaggaaggacattctgatacatgctaaacgtgcatgaactttgaggacattatgcaaagtgaaataagccagtcacctaaagacaaatgttgtatgattctgctttgatgacctggagtcatcaaactcagagagacaaaaagtcaaatggtggaggccaggagctggagaagggggaatgagtggttaatggagacagagtttctgttttgccagatgaaaagagttctggagatggagggaggtgatggtgcacaacgatgtgaatgcacttaatgccactgacccgtacccttacaaatggataaaatggtaaattttatgtatattttaccacaatttacaaaaaaaaccctcacttttcttgcccagaagcaagagaggtactggtttataacttctggtacagagggggagacagaaaaatgtaacggattattctaacacaaaggaaagaatacaaaaggaacacatggaagatgcaaaggaaaaccaacaagtgagttcttctgctggggtcagaaaaacctatggatagaagacgacatttaactcaggtcagtggtcatgcactgtggcttcttgtattttcatcacggagactgaggcaacctcgtgaacacgtccaaggagctggttttcttttctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcttgacctcatgatccacccgcctcggcctcccaaagcgctgggattacaggcgtgagccaccgcgcccggccgagctggttttctaacaggagccctcttggttatgtggctatttccacttaaacaaccgcccttcttggccctctcttctcaccttatctggctgtctggatccatggcattaaaagttcccaacagggtcccaggcctggcgccctcctctttattgacaatgaagctctgggggtgaaaggctggtgggtcgttggcgtctgtcacctgcacactcacagtggcgctggctgctgccttccttggcggctgaagctttcctctctcacagaagacgagcctctcctcattctccacgacaatgatgaggctttgcgctgggcgagtctcataatccaaaggctggaaccccagagagaggatttcattagcacctgctgctcctctggccagaggaagcccagcgccgagtcatcattgcaaactcagagcttgtggcttttgcacttcatttattatttacgttgtctttgataatgatcaaaagacagtctacagctcattttcaaatcatttatggagttcttttctcttttattttttccctcctcctctgctggttgaaaagagccaccatccttcagagggtaatgaaaaatgcaacaaaaaccatagcctaatgaaacattaatgagacaaccatgcagcaaaaaaatcaggggaacttagggaaatatagatattaatgatcatagttattcagggtacaaagtggtcagttgacttaaaaggattgaaagcctgggaatattttgaaaattcaaccccaggcatctggtgcagcgtctacagagccttgctattcatagcacggtccgcaggccatcagcatcccctgggagctggtcaaatgggcaggcgaatcttgggctctgtgccagacctgctgactcaggtctgccttgtcgccaggtgactcacctgccctgcactgcactagaggccctggtcactctagggctggttgtgagcaatgaagactagaggcactggggtcagactgccccagtgggatcctccactccacccctcaagctgtgtggctttgtgtaaaggacctaacccctctgggctttggtttcctaatcagtaaatgagatggtaatattaatactttcttccaggccagcttctccattaggcacagtgccaggggctctccatactcttggagccacacagatgcactcccatttgttttaaactttaaaagtcttaaacattgaaaactcagatgaaaagaaagaacttttagtgttgaagaaaatgttttcattttttaatcacatctgaaaaagaataatcattttaaggcctatgtaaatctattacattttgcctacaacaacaaaaaattaaatggtgaagtatttagtcatatcaaaataagttttattattgatatcattttggtaggaggagtcctcagcccacacacagaagtggcactgagaccctgccttccttgcctggtgacgtgtggtacgtaatgggctcagcacccagcatccacggacgttagctccctggttcattgtgagtgatcctacagaagaggcctcagcgtctgccactaactggttggtatgtcaccggtatggtgttaccttgataacatttaatatcccttcgttggtctcagggtcagtcgaaatgtcaaaatgcccctcttcattgccatgcaatatgttgaattttgctctccaagctgatgtaaatggagaatctcgatcttgaaccaggagacgcaacacgccctggctggctcggccttcaggaatctgaaccttatactgaaagaagcaatcatcatgtccatgtcatggaaacaaaaacacaattgaaaaggaaagcagagaggaaggagggagagaagcagagagagagcaagagagagaaggagaaagaatgttgctcctcatcacaacaccctggatattcctcatgctgctaaacctgccctaagggatttgcaactccgtctgttacagcagaaggtgcatccgttggaatatctgccccctcctacctgtgactcgctaaataattcttaaagtactcttaaatccaactcaatgccctattttttctaagaattttaaaaataataatacacaatcctagtttatgctctctaaaaatcctagctcttcccctaaaataggacacttgtggttattcagattaaggtgatcatttttctaacacatgtagatcttcaaaatagcttgttattcaatacttttggaggcaatgtttctagacaagcacttcaaaataagagggtatattttttttccagccatatttttgagagcattgctttttaccaagccaggaaaagattttgaaacaaggttcaagcataatattattttgtagttattatatacttctggtgaggtgctttggtttgcaaacatttcactttggtttatacaggttttttttctaattaaacgacaccttttaaaaataattgtttgcatcatttattcaacaacagcttctatgtgccacattccatttcagatgccatgaacaagacaggcaaaaattccgtccttgatggagctgagagctgagtgtgtgtgtgtgtgtgtgtgtgtgtgtgtgtgtgtgtgtgtgtagggggatttataaaataaataaaactgattaagtagaacactactaagcagaagaaagcacaaaggagctacagtgtgtcccaggaaagaagagggagggttttaactcagtagtcaagaaagagagtcaggagaaaggaaatatggtggatatttacttttttaaaaatacatatagaatagtaaaaaataaaatattggaaatagatcttgagtgattcttattttatctcttagccatctcacatgccttaggtggggcacccatcccaaaccatcttacacagcggttttcaatgctttcttaaaggctgggagtcttgcagcctgggaaatcccatgtggaccctgacatacaatgtttttaaatgatcactgcagttacttctgtacttggataaggtaaggtatggaaggcgaggccaaagcctacctgctcaccttccctctagaatcctgaacacggtgtgaaaacctcaggtgcagacttctcacccaagggtgattcttctccctgagggacatttggcaatgtctggtgacacttttggttgtcacagctgaggggtgctactgacatctactgggcggaggccagggatgctggtgaatatcccacagcacacagagtagcccccactccaaataatcatctggcccagtgtcagttgggctgagcataggaacccctgactccaagtaaacaggaattccctgtcttcccctagacctcagttttcccatctgtaaaacagaaatcgtgttgtagtttcaataatcaaaaatgaaaaaaatgcatgtaaaagttcttagcatagtttctggcatacagcagtcaaaaatgtaagctcatgtgaccattatgaactgcttctatgtcaatatgatttggcttcttgattctagcttaagtcactttggagaattgcacatatcttgggtgactgcgcgatatagattggagatctgtccccgcccaaatctcatgctgaaatgtgatccccagtgttggaggtggggcctggtgggaagtgtttggatcgtggggcagatccctcataaatagctccggccatccccttggtgataaggaagctctggccctgagttcacatgagatctggtcatttaaaagtgtgtggcccctcttacctctctcgttcctcattcttccccacccacctcccgtgtcttgcatgctcttgttgtcaccgagtgacatgcctgctccccccgtccttccgccatgatcataggcgtcctgaggcctccctagaagctgagccggtgccagccccaggcttcctgtaaagcctgcagaaccatgagccaattaaacctcttttctttataaattacccagtctgaggtatttcttcacagcaatatgataacagcctaacaccctctctgagaaaaactgagcctaggacccaagggctacttgttttggggcttagacgttggggcggcccaggagcctcacgttctcctgggtaaatgcaggcctgtggttgttgccttcttgcacatccacgtgaacggtggtcgtggatgacagtgacggttctccacagtccctggctctgattagcagtgtaaactgaggagcggtctatgtgggaggaaaaggaaagttaagcccctcaaatacaggaaaggaaaatattaataaagaaatattctgtttaggaatttcaatagcaaatctagccacagagggttccccactacaaatgtagaatctaagcctggggctcaaggatgggccacacatttcatttaaaaaaaataataaaatccacataacctcataatctaagcagccagagagtcgtatttctccactaaggcgatcaacccggaaaccactttctttcagtaatggtgtttgagaaatgaggaagtaaaggacttgagaatttggagtgttttcttcatccaaatcgactgctaacatctgaaaaataggttgccctagaaagaatttttaaaaattgttactatcagataaaggtagcctatcaaaccagtaagaggatgaattatttgctaaatggcattggggcatataccaaaatgagtggaatgtttaaatataaaataaactatggacatactagaaaagataaggatgaatatttaattagttataagatcaagaactttctaatcatgactgccaatgcagaagacttacattggtggatcagattacacttttaatttctggcaaaaaactgtggacaaaatttaaaagaaaatgataaagcaggaaaatatatctgaaacatacatggcaggcagatattcttaatatagactgcagaggttaaaatcaagaaaaatgacaaacacactaacagaaaaatgaagaaaagaaaggaaaaagcaactgatagaacatggaaatggtgaagaaacatagcaaaatgttcaagcacatagttatcaaagaccaacaacacaccaagcatcttcgtggactgggggcaggtcagcaaatgaggacccctacattgtatgcacagtgcaaaccagcaagtctacatctctgaattcatgctaagtaaataatgcttgattgggacacagatttagcttaaattttatcattgaaatatattttatgaaaataacagaaagtggcaaaaaaacataaatgttcaaccataggagatcggtcaaatactttaaagcacatccataaaatattacacaacagggtattttagaaaaatatcaggttacaaacagtaaaattgcacctttagagaggaaatttataaatatgcacctgtgaaaaagcacaccaaatatgtgtaaatatttaccatatacgcatatacaatgtgtactatgataaagatgaaaaaatgtatgtatatacaaatatgcatttgtaattatacataaaaatgtgtgaatgcatacacatatataattttaacacacagcatgtgtatacacacacacagaaaatgcacacaaaaatgctgaaagaatacaaactgaaacactaatggttgttatctctcatgggtaacattaaagatgctttctttttcagtcttttcatttcttggaattttttggagagatgattacacaaaaaaatgatttttgttattaaaataaatccacattctagtaagagtcggttgggtttaagaatgcacagtatctgtaactcggaggctatagatgtgatcgtgttgccattttacagacaaaaaatgtgcagagatatgcagaagctcatcacccagctctttctccctcactgcatgtggctttatttttagaatggcatttacatatcaacccttcccactgatgtaattcccacatcattttattgccgatacaaaatgaggcttacggacctcaaagcatttcgctcagatccaaggcctgcgatctttgagatgtgaacagtaaaaactctccctgaagatgactaggatcaagctcctcatcaatattaatgaaaaggaacagagcagagacagaaggaagcccggcagccccccagccgcacacacctgcagattggttttcttgcacagtgatgttaaattccttctctggaaactggggtgcatgatcattcacatcactgatcctaatgttgaaaatcaaggatgtatccacaatttttcctgttgagcgctccacaacatcaaaataaacctaggaagcagagagctgtaaaaatcctgcagaaccatttactcgatgacactctaataaaataactgttatcctaattatgtgttacgtctgtctcctcctctagactgagagttccggagggcaggaatcagactgccctcatttaccaagtaccccagagagcaagaacagtactggcacagattaggtgctcagcaaatgtgtagaacaagccaatgctctggcttggaaaaaaatgatcagttattattaggttcaaatctcagtctctccactgggcaaacacatgcaagttgctagtgagcctccgtttctacaacctatcagtgttgtcatgagaaataaatatattaactgaatattactgaaacatcacagagagcagacagttaaagatttttgggaaagtgaacatttatagtaactagcacagctactgacatgctatatttttaaatggccactgcagttacttctgtacttggataagaaaagtcagtccacgtcaaatatgcatgtgtgaaatctttcacttcaaatggtctcaaatcaattgtttaagcttccaccttaagaaattttaaaaagacatcataataaatccaaacaaacagaaagcaatagtaaaggtaagagcacatatcaataaaatggaaaacaacaaaacaatagagaaagtaaccaacgtaatcgcatgtaaccaaaagcgattctttgaaatgatcaataaaatgaataaacctctagggggactgatgagggaaaataaggaagcggagagaattatcaataacgagaatgaaagaaaggatatcactagagattctacatatattagaagaagaataaggactagtatgaccaagtttatgccaatgaattcagcaacttaaatgaaatggaccaaattcttaataaagaaaaactacgaaaactttctcaagaagaaacagaaaacctgtatagtcctatatatttttttaaagtgaaatttatagtttaaaatctttcaagaaataaaaacaaaaaactccaggcccagatgacttcaatgataaattctagcaaaatatgaaagaagaaagaccaattcaacagtctcttccaaaaaatataaaaggtagaaaaacttctcaactgattatatgagactaatattaccataatacaaagtcaaatttttgtaaattacagggaaaactacagaacaatatctctcatgaatctagagttaaaagttctcaacaaaatactaacaaatagtacccagaaatatattaaaaggatagtacattatgaccaaatgaggtttatcctgagaattttaggctgattcaactttcgaaaatcaatttcagcaatgtcacaagatataaagttaatctataaaaatcagctatatttctataaaccagcaatgcataattagaaataaaaattttaaaacagctccatttacaaatctaaaatacgtataggatctatttagtgaaaatgttaaaacactgatgaaagaaatcaaagaagacctaattgaatgaaaagatatactgtgtttacagactgaaagactcagtattgccaagatgacagttctttccaaattgacctataaagtcagcatgatcccaatcaaaagactagcagaatattttagagatatcaacaagctgatctgaaaattatatagaaaggcaaagaaatttgaatacgcaaaatcattttgaaaaagaaacacaaagttagaggactcacactatataatttcaagatttattataaaaatacagtaatccagagagtatagtattgatgaaaagataaatatatacatcactgaaacagaatagagagtttagaaataggcccacacaagtatggttgattgatttttgagaataatacaaaggctagccttttcaacacatgattctgaaacaattagatgttcataagcaaaaaaaaataaacctgggtctatatctcacactttagacaaaaattaattcaaaatggatcacagacatacatgtaaaacataaaactataaaacttttagtaaaaaaaggagaaaatcttgatgacaatgtgttagataacaccaccaaaaacatgatccagaagagaaaatattgatgaattggattttatcaaaatgtaataacttttgctctgtaagaaatgctgttaaaagaatgaaaagacaaaggtaagaatgagaagacaaaaatgaaaagacaattgcctgagagaaaatacttccatttcatatgctgacaaaggatttgtattcaaaactcaataagaaaacaaacaatatatggccgggtgtggtggctcatgcctgtaatcccagcactttgggaggcctagccgggtggattacctgaggtcaggagtttaagaccagcctggccaacatggcaaaacccagtgtctactaaaaaaaatacaaaaattagccaggcatggtggcaggcaactgtaatcccagctactcgggaggctgaggcaggagaattgcttgcacccagaaggtggaggttgcagtgaactgagattgcgccattgcactccagcctgggagacaagaaagaaactccatctcaaaaaaaaaaagacaaaaacaatacaattttaaaatgggcaaagggtttgaacagacacctctccaaaaaaagagatacagatagtaaataagtcatcatttgtcactagggaaatccacattaaaactgcaatgagatatcgctacacaccttttagaacagctaaactgaaaaaacctgacaatactaagtgcagccaaagatgcagagcaatcagaattcttatacgtttctaatgagaatgcaaaattgttcagttattctgagaaatcgtttgggaattgcttatcgagttaaacatacacttatgtgatccaactaagccactcctaggtatctacctacaataaatgaaaactgactttcacataaaagccatatgtgggctgggtatggttgctcacacctgtaatcccagcactttgggaggctgaggcaggtggatcacgtgaggtcaggagttcatgaccagcctggccaacatggtgaaaccccgactctactaaaaatataaaaattagccaggtgtggtggtgggtgcctgtaatcccagctgctcaggagactaaggcaggagaatcgcttgaacccaggaggccaagattgcaataagctgagatcgcaccattgctctccagcctgggcgacaacagtgaaactctatctaaaaaaaaaaaaaaaaaaaaaaaaaaaaaaaaaaaaaaaaaaagtgcatagcagctttatctcaccacaattgaaaagagtccaagcaccctttagttttataaagtgagaagcaagatactactcagcgataaaacagaacaaactcggctgggcacggcggctcacgcctgtaatcccagcactttggtaggcccaggtgggcagatcacaaggccaggaggtcaaggccattctgaccaacatggtgaaaccctatctctactaaaacacaaaaaattagccttgcatggtggcaggcgcctgtagtcccaggtactcagtagactgaggcaggagaattgcttgaacctgggagatggaggttgcagtgagcaaagattgcaccactgcattccagcctggcgacagaacaagactccgtctcaaaaaaaaaaaaaaaaaaatagaagaagaagaaactcttgatgcacacaatgacatcgatgaatataagattcattatgtgaggtgaaaaaaatctagacttaaaaagccatgtattgtgtgactccgtctctatgatgttctaaacaaggtaaatgtattgggagggagaagaaatgagtggtttccaggggttaagggttgaaggagggtttgtcaaaactcttagaactatacatcaagagatacaaattttaccgtacacaagttttgaaaataaatttttaaaagtaaaatacatataaatttggaaggaataaaggcagttgagggttctcaggtcattatattgtcaaagaagttattaaaaacttcatatcaaatctaataagtgaagagtgaatgttatattttctctgtaattattttctccttctgtggaattagaccagagagaaaagttgtgggtggggtgagatttttcatatattgtacaaaattttgtaagaagccctattaattttatatgtaaaaagtaaatataagatcgggcgtggtggctcacacctgtaatcccagcactttgggaggccgaggtggggggaccacctgaggtcaggagttcaagaccagcctggccaacgtagtgaaaccccacctttacaaaaaggcaaaaattagccaggcatgatggtgggtgcctgtaatcccactactcgggaggctgaggtggaagaatcacttgaacccaggaggcagaggttgcagtgagccgagatcaccccattgcactccagcctgggtgacagagcaagacttcatctcaaaaaaaaaaaaaaagtaagtataaataataggaactctcatttattgctggggagaatgcaaaatggtgcagccactttgggggacagtttggcagtttcttacaaaactaaatgtactcttgctacacaatccaactatcagccttccaaatgtgttgaatatgtatgtgcacctgacaacctgcacacacatgtttatagctttattcatgattgtcaaactctggaagctaccaagatgtttctcagtaggtgaataggtaaataagctgtgtccatccacacaatagaatattatacaatgaaaaaaaggcatggaggaactttgaatggatattgccaagtgaaagaagccagtctgaaaaggctacatagtgtatgattccaactatataaccttctggaaaaggcaaaagtggggagacagtaaaaagaccagtggttgccaggggttctgggggtagggaggggtgaatgggcagagcccagagagttttagagcagtgaaactattctatacgacactgtcatggtggacacatttgtcgaaacccataaaacgtaagatgccaagagtgaagcctaatgtaaactatgggttttggttaatagtcatgtaaaatactggctcaacaattatagcaaatgtagcacatacattatagcaaatgcacacactactgcaaaatgttcataataggggaatctgaagggagggggtagggggaggggaggatgggaactgtgctttctgttctgtgcttctgtcaatctaaaactgctctaaaaaataaagtccattaatttgaaaaaatgatgtccctacttacaaaataaatatatatattaataaaatataataaatatgaactataagaaaatatacatgtgtattttaaataaatatacatatttttaaaagcaagtcgaatcaggcttgctcctgaatctctcattgctctagtataaagggtgcttttgtttgttgaaggctgaaaaggctgtgggcaaaggcaggagttcagagtcgcagaaaagggagtgggaaagggcacggatcctggcacgagggtggtccaggcagaggcctgttctgcagtcagaccactggattctcaagggtcaactggtcgccaggtacagtatcctgcttggggtaaaaaggtttattgcagaagcctggctgccagcttcagccaggcccagggcggactcaccagcaccagcccttcccgtagatggcctctgctcatccccgcggaagccctggaggaaggcacccttgctgtccagctctgcaccatggagagactaagtgactatttcaccttcagcttggaagtagagtagcccagattcaagtccagtcagggatcaagactgcaccttccgccgattcttcctcacttcactctatggctactcagtgcccagggtcggtggccctcccagggggcctctaagggccttgaaagctttaggcaacactctctccatccccttcctcaggggcctaaatgtctttccctctgtactgtttcgcatgactgcctgagccccctttccctgcagacttgtggctcattcctctgcttccatcaccgtggtcccaccaggtatcctagcacagcagcccctacgtctagcgcaggtcagtgctcctcctcccccacagcaggactgagggaggcttcagggcttctaccactgagctagtccgctgcagggactccagcatacatttttaaatttttgtgcaaataaattggctttctcactcaccatctctacattctcctccataatgtatgactgtgctggcaactctttgctccttaatcaccctgacttctggctgtaaaactgtgccaactgtactccttccatttaaaaaaagaaccacttgtgtgttttatgtttattattttatatttcatttattatcctaaagctacgtatgagacctttagttccataagatgcctgagaaacatgagtgctgtttattctttggcaagatgctaagaatttctagggattcgggttacaatggagaaaagaaatgtcatggacattttctgcacttggaaagtgtttccagcctttggttatagcctcaagatttatacctttggataaacaaaccatggtgcattaacttgatacatcacatggctgtttgaaattacaggcacaagatctgcggccttacatgcaaatgagcacataggaacaccttcagcgccaaatgcacaacacaaaatcgctactgcataggttagactgtgtggtgaaaaaaattaacaaataattattttgagaaatataaaaagatgggttttggggtagctttgtattctacaaaaatgagcatattttgatataaatagataaggtccatacacagaaaaaaattgaaactttttctgttgctgtcctctgtctcaaatcttacagtaattctcaaccagggctactgctttcttgtacatgcatggagttaataaatgttagcctcccccacaccaccccctgaacacaatttttcttttggctggttttagagaccccatcaggatgctcaagagtaaagaagtgctactagaatgtctttttgccactacattaggcttacttgatttttaataatgtactatcttgatggactgccaaagccaacaataaacgctctcttacaggagcagatggttaagctaggatgctcaatttgtgtagtgtttaggacacgtcctaatttataggacatgtcttatgccacccttccttgttggtaatccttctcattggaccatttcatatgctcctaaatagtgtgtaagcccctggctgttagtttcctgtggctgttgtaacaaaataccatagacccccatggcttacactaggaacttattctctcacagctctgtaggctagagctgaaatggaggagtcagcagggttggttcttctggaggctccgaaggagagactcttccgggcctctcctggcttcgggtggttgctagcaaacctcagtgttccttggcatcactctaatctctgcctccaccttcacctggcattctcctctgcgtctgtctctgtgtcaaagattctctcttcttctaaaaatactggtcactgggttatggcccaccctaatccagtatgacctcattttaacttgattacacctacaaagaccctatatccaaataaggtcacaggggtaggtaccatgaattaggacttgaacatgtatttttgggagacacaattcaactcacaacacccagcaaggccgaggctacattttactctgcttgttcattcatttactccttcatctaacatgattaagggagaacctattatgtgaggagccctgatcttgaccctggggcaatggcagactttccccaaagtcaacaataaggcagagtctctcccctcttagaactacattctaagaggggagatcagcattctaatggaggagatcaactatcaacagataattaaacacaaaattcacatttcaggtgatgagtggtgttgaggagaaaataaaacagggtaatgagacggagagtgacaggcaaggttggggcatgcctcagaatccccaccctgtatctttccttgtggaagtctgtagttaaatgacagggccacggatcaaataagtacctaaatcaatattaaaagacaactgtggtcaatgtttgggggatcagaacatgggtttggcctagccagggagctccaagcatagggccctgaaaacctgacataacagaattaatggggatgccatgtgtttccccccaccccacactgtcactctttgctctaaatggtgcctaggatctatctgtgatgcaccaagcatttccaactcaacttcgagtttcaggaaatgctgttagatatttggctttagcattatcagcttttagacacaaagtcccattttagacattatgaatgccaacccttaatacatcatttaaaatgttaaaagcatcgttcacaaaaatgttctcccattctgcaggttgtctgtttactctgttgatagtttcttttgcatctgaaagatttaatatctagcatctataaggaacttaaaattacaagaaaaaaaaccccattaaaaagtggacaaaagacataaacagacacttttcaaaagaagatatacttgtggccagtaagcatatgaaaaaaagctcaacatcactgattattagaaaaatgaaaattaaaaccacaatgagataccatctcacaccagtcagaatggctattattaaaaagtcaaaaaacaacagatgctggtgaggttgcagaataaaaaggagcatgtatatactgttggtgggagtgtaaattacttcaaccattgtggaagacagtgtggtgattcctcaaagagctaaaaacagaaatattattcaacccagcaatcccattactgggtatatacccaaaggaatttaaatcattctatcataaagacatatgcatgggtatgttcattgcagcaggattcacagtagcaaagacatgaaatcaacctaaatgcctatcaatggtagaatggataaagcaaatatggtacatgtacaccatggaatactatgcagccataaaaaagaatgggattatgtcctttgcaggaacatggatggagctggaggccattatccttagcaaactaacacaggaacagaaaaccaatactgcatgttctcacttatagataggagctaaatgatgagaacacatggacacacagaaggaaacagacactggagtctctcagagggtgaagggtgggaggagggagaggatcaggaaaactaactagtgggtactaggcttaatacctggatgatgaaataacctgtacactaaaccctcattatacaagtttacctatataacaaacctgtacatgaacttaaaatgaaagttaaaaataataataataataaaaggaaaggaaaaaataaaatattgaaagcaaacaagcaacaacaacaagtgagcactgaatgtttggttccatccttgcacagaccatgatcatcactaggtcctccctactcaatgtgtggaagcccgaggaacagcagcatgggcatcacctggagcttgctagacatgcaggctttcaggcttcaccctgacctactaaaacagaatctgcatttttaccaagatccctaggtgatctgtttgctcatgaaagattgagaagtgctatctcagggtctccttatgactactcttctttttaacaggcactgttaaaagtccttctttttaacagacactgtgaattctgcacagaagggaggcatgcattcatacagataaggaagacctagagagtcatctttgcatgttcattggagttttagaacaattttcaccgatttaaaaattagagattcagagcctatcagtgagttaagggtatatcttttattgtgtatataagtactttgagatcactggagaaaagcttcaactattacttttcttgaatgttaatcaacatctttccaccctgaaagagttaatgaacaaatgtacagccaagcacgcctgagaaccaagcccagttcccagcagctccattccactgaagtcaaaatagaacaaagtttgactacctaaggacttcctatgatgttaggtgagtaatgtgatacatggttcagggcttttttctttataatttcctttcctagtttacaacctgaatttcaacttcatagtaaaccacagtgttgcagtgatgaaatcgtaaagaacacctgcactcacaataagacattgtcaacaggtatgcaactgctcatgcatcagttattgggcaacccattgggtctgttatggcttgtctccatatttcagaagtcactcatcaaaaaataaattagcccattttataaacattctgtgaccctatacccaaatgctttctgatatcccgatcatgctaggacactggtcattagaataaagacctatagcagctcacatcgattgcagaaatcattacaaagccaaagtccacaactctaaaagaagattacaaaagtctcaggcatactcgtaaagcttgtcacaaggcataatttctcaatctcccggaacctggcacatagtcagcttaaataatgcttaccaaatacaacagtcttgcaagagcttttaaatccgagcttagaatatatcaagttttagataccgtgaaagatggtgtcatttctcgatcgacagggcggtgaacatatatccttccgttctcatgatcttctagagaaaacaaaccaatctctggatattcatccacaccaggtccactgattagatacattagtgacatgttataagacatattattgaacagctggaaggaggaaaaatggaaagaagaaaaaaggaggatgagaataagccactatgataatcaagtatcaaggctaagaatcaatggcatctttaagaaattatacccagcaatggcacatctgccaaagaaataaacagatgggctgagatgcaggaacaatgatgttgaactgttagcttcagtttggtctgtaacagtgaaaatttggaaatagcataaatgttcatcaacatgaaaaaaataatataatgatacttccttcacatagcatgggatactctgtagcctttaaagatgtatttacactgccacggaatgactagcaggacacatcactaaacaagaaaggcaagcagaacaacacaccaagtgtgatctcatttcttggatgcagattcacatcagaaaatctgtagagaaatatctggaaccacacataccaatttattaatatcaattatcccttgaaggaaagagaagtagtgatcacacaactaacatttagaaagagcttagaatgagtgggcctacaatatgccttgcttgccttaacctatttaatctttaaaacatctctgaaatgtaggcaatatcattgaccgcattgtacagatgaggacacgttaaaaatctctaacttacccagcaaggaggtggtgcagtaggaatatgaacccactcactccccctgactcttaggcatatacacttttaaccactgagacttgaaaactttctgtactctttatgtttgtttttaacagtaggcgtgcactatttccttcttctaagaatcatagaatgccacagctatagcagaacttaatcagcacttaattcaaaggcccattggtactaggaaggtagtggaaataaacaacatgagcctggtgtaaagattctgctattccaataccatgtgacttcttcaaggcagtgctcaccctcagcatgagggaggcaatagggaggggtggaaactggtattctgagtaactcaagccccgcctaattgttgtaatgtgggaatgtgggttccttgtggccagaactttccatttttaaaagtctttagaagggcaaaatttttaagacaatctcccttatttatttatttatttatttatttatttatttatttatttatttttgagacagagtctcgctgtcgcccaggctggagtgcagtggtgcgatcttggctcactgcaagctccgcctcctgggttcatgccattctcctgcctcagcctcccgagcagctgggactacaggcacctgcaaccatgcctggttaattttttgtatttttagtagagacaagatttcaccatgttggccaggatgggctcgatctcctgatctcctgatccgcccgcctcggcctcccaaagtgctgggattacaggcgtgagccaccgcgcctggccgacaatctccctgtttttaaataatatttaaaaaaaaaaaaagcctctgcatgggccaaataaagcagacctgtcagttggaattaaccaccctgttgctgtatgagattctcatcagacactcacatggagaagtgactcgttcaaactcacataaccaggtagagttagagtgagttctagaacccaggcttcctgaaccccaggccagtgctccttctgctctacttcactccctggcctcactagcacataacctttcaagacttaatcttcctggccaaaggggcgtgcttacttagagggcatgatggggtcattccttaagagtaggcaccttacctcaccaatgagtttgggaaagggtcccgggtcttcctcctccagctccaaggtggtgataacccatcttctcttggatcgccgtagaggctggtagatcttttcctggaacttatagtgacactggtgacaatgaggatggcagtgatgctcacagccaggatttatcacacccttacttcatgtaaaggccctgtgctgacacctggcctgcattctctcatcgccagaacagccacctaagcttggaaaacccaagtgcctgtcttcttaatagctgtagagtcatctctaaccacggggtggatgctgtccgatgatttgacgtggttcttgagataatttcaggagctatccagacatagcattaaagatgactgtctgctatgtgccaatggctgtcctatagtagacatgcaaacggttgttgagaaagttttcccacttccatttatctctcagtcttcctgaaattattgatgattaggtgctgacagacctttaatgcctctctgtctatgactatcccttttaacaaatgtgcagacatgtacacaaagagaaagagagtgacttagactcagatcttgggctcagatatttgtcaggtaagagaatatatgaaatttaaagcattgttttgtttgcattatatattttcacagttaccatctattataagtgaagttggtttctagccacattaattttatcaacaaaaatgtaagttcttttttaaaaaaattacttaatgatagagtgaattgaccaagagaacaataccaagtaaataatcacaacgtggcatgaggatatggcaaaacttcacagtggtaggtgcatgactgctgcaatggaaaatatgaagttcaatatattttaattccataaagaataaaatgatgtggacaaacctccatgcttatggtgtacagttgaattttgatgttcacaggctgctcacattctaattagacataaaagcatcacctgcaactctctggcagtccctcaagattctaaaaggccacatgaagttactattttattttctgcaaaccaaacattggcagggcactaaagaactccaaactgcaattctgtctctaagtcaagtgtagagactgattttatatattaagaaactgacttccaaacctcacctttgtttgcttagtaagatcatctgtttcctgttgaacactgtcaatgatactgaccttaaaaataaaaataatattaattagtagagaatattcttaccagaatcacatggaaaccacctggagttgcacaaatctagaattagaaatgatgaaaacagaacttctgtagttagttttggtaaatagaatttcttatcctctacatcttaattcatgattgccacttatcttctctaactataggagaaataatgaaaagaattctgatttattattaccaatggtggggagacgtttaaaatcataaaatactactgttagttaacaaagcaggaagtagaacttgtttattcaggatgagcacagctgtatttatatgtacacatgtaaaataacaccaaatattaattggtgatgaggtttaagtgggcttttcttttgttttttttgccccttatttctaagacattatttacaataattaataaaataatagacatggcactttacatttacataatgacttagagtgataatacttatttataatttatatctcaacaatcctttcccttcctccaaaaaatacatgtacaagactgttgaaatagaaagagataagtcagccaggagcggtggctcacgcgtgtaatcctagcactttgggaggccaaggcaggtggatgacctgaggtcaggagttcgagagcaactaaccaatatgatgaaaccccatctctactgaaaatacaaaaattagccggccatggtggcacgcgcctgtaatcccagttacttgggaggctgagacaagagaatcgcttgaacctgggaggcggaggttgcagtgagatttgattgcaccactgcactccagcctgggcgacagagcaagactccatctgagaagaaagaaagaaggaaagaaggaaagaaagaaagagagggagagagagagagagagagacagagagagagagagagagagagagagacagagagaaaggaagaaagaaagaaagaaagaaagaaagaaagaaagaaagaaagaaagaaagaaagatagaaagaaagaaagaaagaaagggaaaggaaaggaaaggaaaggaaaggaaggaaggaaggaaggaaggaaggaaggaagaaagaaagaaagaaagaaagaaagaaagaaagaaagaaagaaagaaagaaagaaagaaagaaatgagggagggagggagggagggaaggaaggaaggagggagggaaggggaaggggaaggggaagggaagggaggaaggaaagaaagaaagaaagagagagaatggtcctgcaatgtatgattagaaccagcagcaaacgaaagggtgggagtggggagggagagagacagtgtgcacgcaggatgactagaataaagcaaatggggcaaaaagtataaacaactggtaaattttcacacggggtattttggaattctttgtattttccttaaatcttataagttttataccaaaacaaaaacttatcaaaaaagacaatttcaggaactaagattgggtattcaatttagcactaagattcttgccagttataataaaaagggaaagtctgtctttaaaaatgaaacatttttaataaaaccttttcttgttatacagtcttcctatttaaaagaaaatttgatagcaaaatgctttgagcatacagaaagaaatagagaatgacataatgatgcccatcacctagttctctcaaaccttcatacttttaccctatttgcttcgaagtgttgagatgtaaatcgttacagataaaattgaaacttcctgtgtacccctccctcatctcactttttcctcagaagtaactctcatcctaaattatacttagcatttcaatgcatgtttttaaaccttcactatatgtatctgtgtgcatagatatggctatatattcataacaatgtgtaatttttatggttttggattggacttttaaataatggttcacagtaatcatcatcccataacattattatttttttttttacttatcattgatttttcattttgggggaggatgtgtgtgttaacacctacagttctagttcattcatttttattgctgtagaacatttcactatatgaataggtaataatctatttatccattctcctagtgatggtcatttaggttggttccagtttttcattaccaaaaatgctatggtaataaacatccatgtatatatgaaaagtttctctgtagcagcaattttcaaagtatggtttccacagccctgtaagagagtccacaaggccaaactctttcataagaacactaaggcattgtttgcctattttgctgtctgacatttgcactgatggtgcaaaacaataacgttggtgagtggaattgctgatgcctcagcacaaatgaaggcagtggtaccaaactccccattgtattcttcaccaccatgcacttgctcacgcacttgcaggaaaaaccaaaaagaaacacaaagaaaactagtttcatttaagaatgaaataattggtgaatttactcaattactgtaatcgcttgagaactcatgaagtagtaaaaaatattaattgttttaaattgcaacacttgagtgtacatcttttaaacactcttcgtgagtggatgggaagtatgtacaaggcactgctgctgtacatcaaggcagaaggtttatctcaaagaaaagtacttgcgtgattgcttcagtttccagctgaacaggccacttttttttttttttttttttttttttaatgcaacaccattttacttgaaagaacaaccaagaaactgtgatgattcacgccagggtatctgatatacggttccttgatgatgaacaaagtgagctttcacttcgagaaaatcaatcaatgcacagtatctgttcccactgataaatgtaatctttcaagcaaaaatcagaattttagaaaacttgtgtctgccaatataagcatgaaagcttcctaataattaaagatttttactataatagcaatagtttctttttaattttataggctgaaatatgtccacacaggaaatacctgcataactcaatagccaatggcttcctaatgatcaacacatcatgttctaaaatcatgtgcaggcaaaagagtcatccagagtgcaagagagaccagtggattttaatggaacggagtagggaaaattcagtgatatggtttcagattccacccagtaaataactgttaagacattacagtgtattgagttttggtgtaatatcaaagaaaaatatccacaattatctgttccaggttattaaaatattcctcccttttcaaatatctgctcgaggccagaatttcttcatatactccaaccaaacaaattcacaacagactgaatacagaagcagagaggagactcccgctgttttctttaaagccggacattcaaaatatttgcaaaaaatatatagatagtggcactttttccactaaatggaattttgaaaaatatggatagtttccaaaatatgtgctatttttattaacatagaatgggtttattatggttatgtccaatgaattgagaaatatgtttaaaatttccctgttttaatagctatcatggtatcagcaaatataacccacataagctaaatctctaggactgatacctaaatcaccagggacagagcctccactctggttggctcgtccgcgtcagaatctatcattatttatccttattcacattacaatacaagaggccatggtgggtggtgggtgggtgatgttattgggttgtattgtcagcatcagggctaacgataatatttgtttcctggccaggttatatttctgtctatttacctgaaggaaaagaatgtttaaactctgagtttaagtctgaaatctcaaactgatttttttagacaatggatgcttcttgattaatgtcagtagttttaaattaagggcctacccaggtgtataatttttaaatggagaaaattgtagttcttgcaaaagataaagaaattaattccgtttctgaaacaggtgtatttccaggtggccaaggttattaacaaggaatatattgaggtttcttgttccctctgggcctcagtttccccttctgtaaattgagggtatgagacaaggtgtctttaagggctctttcaacactaaagctctgtaaattcattttattatgataagacataaacggcacagttgacagtcatgtaagagctggctgaagtgttcaaaaagaggtttgaaatggtggatgtttatactttgccagagatgccttaaatttcacattgttgtgtgtgtttcatttctcctctctttatgcatgtcttagaaattaacttgagatctctcatctgggtgatgcaggaagactggaaattgttatattttctgtaatgattttgtaagtgctctcattatatttctcatctgtgccaaatttaggcagtctgtccaaagaggaaatctttcaaaagatttacataatgctttctataatgcggtggtgtgggcctggggtcgggggcggggggttctttctagatgcttgttccctcagctaccatgtccaccaaaccactttatcagagggggccaggcagacatatgattgcatggtccgccctgcacatgatttgacagatggctctggacctggggcatgtaaccaatatcattcaggctggcctggctgggcagccatggcatcttttgggagaaaattctctgaatgaatgaagatgtaatctgtgactatacaggatactaaagagctaagaggcctatatagaaatcattctctcccaaaatgcttggaagtatttcatttttaaatgcaagtttttatttaagcagaattcgagtcctaaaaatcagcagaatttggatcaaggactctgttctgcaggtttatgtctttgttccagattcagtgacaagtaatgactagccataggaaaggagtctttctcccctcttcagtcatttccagttctgagagccgacgagtcctcagcttgggtctgtggcaggcttgaaagaccatggaggagagaggttttaagataatgaaattggacagtgaggaaagcctcttttttttttttatttttggatgatgaggaaagcctcttaagctttcattcagggagaatttggaccctagaaatcacagaatttcctatgagagattcctctagagattcttttaatccgtacccaatatctctcttctgggctctagaccagggcagtcctaggaaaatctctgtgaagatgagaatgtccctgctgtcctggccagtgtggtagcccctagccacatgtggctaattgggcccctaaaatgtggctagtgctagtataggactgaattttaaattttgcttaattttaattaacttaaattgccacatgtgactagaggccaatgcagatagtataaagtattggttaagcatgtggatttataagtttagaagacctgagtttaaatcctgttctatgggcaatatggcaaaaacctgtctctacaaaatatataaaaattagccaggcatggtggcccatgcctgtagttccagctacttgggaggctgaggtggaaggatcgcatgagtctgggaggcggaggttgcagtgagttgagatcataccactgcactccagcctgggcagcagagtgagaccctgccaaaaaaaaaaaaaaaaaatccttatctacccctcaccagctatgtgatgtcgggcaggtaatttatgctctggagtctgcatttcctcatctgtgcacacacatgcacaacccccacatacgtacatgtataagtgtttgtatgtatttgatcctcacaacagcccaatcatgaaggtactattattattcctttttaacatacaacactcacacacaaagtgctcaggatggcaagggctacgtaagtatctcctctttttcctattcaagtctctaggcaacatttccactggcatctcccacaagcaactcaaatcctacatgtcccagactgatagcatagcttgtattctcacaatcctgcccatcctgggggctctctaaccacaaaagacacttacctactcattccaaaggtcatccttgatgcctctgcttctctcatccccatgtccaagttctgtcaagttcacttcctaaggccagctcttctctgcctccaccccaaacagctaaagtttccaccacctcgggaacccacaggattggtctctcccattcattccatccttctgtggtgggttgaattgtgtccctaaaagcgtatattgaagacttaattcccagtacctgtgaacgggaccttatttggaaataggctatttgcagatgtaattcttaactgaattacagttaagatgaagtcacactgggttagagtgggccctaatctagtgagcagtgtctcgataggaaaacacagacacaaagggatgatgccatgtcatgacaggggcagagactggagtgacgtagctgcaagccaagaaacagctgggattgccagcaacccaccagaagctggggagaggccagggagggtcctcccagtctcagacggattttggccctgctgacgccttggtttcagacttctgacttctagaactgcaagagagtacatttctcctattttaagccgacgtaccagtttgtggttcattgtttcagcagtctgaggacactaatatatgttcctaacacattctctgcacagaggcttgagtgatctttaaaagcacagatctcacacccctttccccccagtgtttttacttctcttaggacagaatccaacctgctctgtcccctgctgaccctctcagcttcacctctgaccacactatccccaccttctgcaacccatcactctgttggtcttaaatgaagggctgaaagagtaattcagtcagagcataaatgctaacaatttattaaaatgtaactcaattcagaatttcccagattggtaacaacgccaccaccaccaacaacaaaaaatcataagtggcttttctcattgtacagtttcattctcttaaaacttccctcttctctggtctttgaagcctgccacagccccaaggtgaggacatatgagctcagaggcctggaaatgacaaaaggggagaaaactcctcttccttggcttgtcattacttgtcactgaacctggaacaaagacataaacctgcagaacagaatcctgacttggtgatttggcttcatggccaaatgacaaagaaagggtgtggggatttcagaggaaaactattgtggacacaatagctctccagcagaaatggtatcagcttgtaaatatggagatctgaacagggggaagtaggtatctgtcatagatgtcacagatggcaataagccaattcagggggcggggatgtaaaggaatggaacggaatgttactcatagccaatttgacaattattgagcacctgccaggtgtaaagctctttaagagttaaaggtccagcattctgattgctaaaaacttcttacatctattgaatcatgttctcttcatctgtcttgattccctggaatctacataaagctgctgtcatcaatcactgaagtacaatccacagacccattcccactgcccacccccacccaaccaccctcagaagtcaattaatttgctttggcactgcactaatacgccagagggaagagaattcaggtctgtttcctgatcagactcattgtgggtaggagcaggagtgagggaaggatggggacaggatttgatctggactatattcaaatccatgcaaacatgggctactaaaaaggacttctgtgaagtattggagatcaaattaatgtgctgtctgactaaggaaactcgtaactcttgatatggcaaaatgtgaccaagaaaattctccaaacctcaagcaactggtaccaaacaagttatccactttcagacagggttttccccctattatgtttattggtgtattcccagtgcctggcccaaagcaggtatccagtaaatagttttagcatgagctctgaatgaatattgccaaccattttcactgtgattagaaaaacggctgggtcgttactgaactgtgaacctaatagtagacagaggctctctaagagaagatgacgtttgtctgggcaaggacatatccatgggaatatgtgtgccatggtaaacgatgtgcagagtcagggaggtaaagggagataaaggttttcaaaggaaaaaatgagaaggattatatcattgttttgaaataattatctttggctacaaagatcaataagaagggtgacactggtctgagtttgcacaaaaagttgctgggaagatttcttcgaaaaagtattttttgtgtaaggttttaacggcctttgtgcaaagttgttatttttgcagagcttttgtgatagttttagttatcaagcctacaaatgtgagaacccccttttcataaccttctttgtgtctatatatcaggctttgtgcctgtgtgtgtgtgtgtgtgtgtgtgtgttttaacataaggaactccattctgattctgacaactttcgcagtaccaagggcttttacgcatttcctcattcactggtacaaccactggctcagataaattcagttactagctccattttcaggtgaagaaaaataggcttaacaaggttatgttaaaaccagtgcactgacacccagtgcactcccaggtcagctcaacctgaacctttgggggcaaaacccaggcactgagatcccttgaagctccctaggtaagttcaacttgatccaaggtaaggaacaaagttaagctggcctaggtccccagcgggctgtgaaggagcctaggtcaggacgccaagcagcccagtccagagctcacagttaccagccactgggctgcttcccaccctcagctggtattcaaaggaagaaatgattccctctccctacctacagaaagccaacgaagcagatcataaccaacaagcgcatgcaacattacctctgtccactctaagtacaaacagagcaagcccatgtgtttcgaatcctgactccactagtttgtattcccatttaaacagtggcagttgggggcaatggatttagccattccatccccatgggtttgctcaaattgccttggatccagacaactgagatttcctcaatcttatgtaaagtgtgaacagaagtatcattataaaacttggcagggcgcagtgtctcaagcctgtcatcctaacactttgggaggctgaggcaggcagatcacttgaggtcaggagtttgagaccagcctggccaacatggtgaaaccctgtctctaataaaaatacaaaaactagccgggcatggtggcgtgcacctgtagtcccagtactcgggaggctgagccaggaggttgcttgaacccagtaggaggaggttgcggtgcactgagatgtcaccacgcactgtagcctggatgacgagaccctgtctcaaaaaaaaaaaaaaattgtgtgtgttggctgggtgaggtggctcatgcctgtaaacccaacacttcggaagggcaaggcgaataaatcacttgagcttaggagttcgagaccagcctgggcaacatggtgaaaatccatctctataaaaaatacagaaattagccagcgtggtggtaagttactgtagtcccagctactcttgaggctgaggtggaaggatcacctgagcctgggaggttaaagctgcagtgagccttgatcatgccactgcactccagcctggatgatgaagccagaccctgtctcaacaaaaggagaaagaaacaaagaaagaaaacacgtgtgtgttgatgtaatctcactaaaaatagtgtgaactatataaattagttttaaacaggtcccttagcctgctcccactgttgccccaaacagactgggacccttaacttccctttatataaatccagagcccctgctacctaagccattctcaagacagccagccctgggtcccagcaggtcacactcagtccctctcccctcccttagcctagaaggggcagggccagcttgtgctttgctttcagttccctgcacctgagcactaggctgcaggctcagcttacctgcagcagccacagcagcagcactagaagcagcagcagcgaggggtgcctcccggatctcatggccatatgggaatacccaagacagacccagaacgtgcagctgatgaccagtcctccaagctggtggtctcaccggagccacacacctccttctcagccagcagcttcttctctaaaggttttcaggtcactttggcccagatgctttcatcccatcttgctcctcccttttcagcttttcttgcatttatcagagtggggtgggctgacttgtaagcttgaacatacgtttgccacaagtagagttcctaggaagggtggggtagaaactaaagccaccatggtcctgcacgtacacaaaagactggctggggtctgacctcaggaacaacagctcagccagcggaagtaaaaccagcacctatcggaaagcagaattatttgtttctttgtttccttgtttgttctggtttccaaatagaaggtccaatcatctctttctatagcaggatatgttagtgactattttctataatcttatcctcttgaaccaaacaaaaaaaactagaaaatgacaagaatgataactttattaagggggaagggatggggaagaatgaaagaaaagaaaaatcaacttttactttccaaagcactaaaaatcgttattccaacaatatcccagggctctggggttttcaaattatttctactaaaaccttttttaagcttagattaatctgcctttttgagtttggaattaaagtgggagggaggagagatgggaaagagcctccctatggacagggatctctgtggcaacccgggagtctttgcatgagaattctgaaagagacaatttgagattatattataccaatacttaaggttgcagtaagcaagttttaaaacacaatctgtgatacattaaccctgattaccttaacatgacctttttatcacattaccttgtttaaagtagtaaacagataaaataaaaggtaaactttctttgcttgttctagatattggcttaggcaaggatttcatgaccaagaaccaaaaagcaaatgcaataaaatcaaagataaatagctgggacctaattaaactaaagagcttttgcactgcaaaaggaacagtcagcagagtaaacagacaacccacagagtgggagaaaatcttcacaatctatacatctgacaaaggattaatatccagaatccacaatgaactccaacaaatcagtaagaaaaaaacaatcccatcaaaaagtgggataaggacatgaatagacaattctcaaaagaagatatacaaatggtcaacaagcatatgaaaaaatgctcaacatcaccaatgatcagcaaaacgcaaatcaaaaccgcagtgcgataccaccttactcctgcaagaatgaccataatcaaaaaatcaaaaaacagtagacgttggtgtggatgtgacaatcagggaacacttctacactgctggggggaatataacatagtacagctgctatggaaaacagtgtggagattccttaaagaacaaaagtagaactaccatttgatccagcaatcccactactgggtatcttcccagaggaaaagaagtcattattcgaaaaagatacttgcacatgcacgtttatagcagcaaaattcacaattgcaaaatcgtggaaccaacccaaatgcccatcaatcaactagtggataaagaaaatgtgtatatgcgtatctatatgtatatatacacatatatgcgtgtatatatgtgtatgtacatatatacacatatatgtgtgtatatatgtgtatgtacatatatacacgcatatatgtatatatacacatatatgtgtatatatgtgtatgtacatatatacacatatatacatacatatatacacacatatatgtatatatatacatacacatatatacacacatatatgtatatatatacatacacatatatatacacatatatatgtatatatatgtgtatatacagatatatatgatggaatactactcagccataaaaaggaatgaattaacagcatttgcagtgacctggatgagattggagactattattctaaatgaagtaactcaggaatggaaaatcaaacattgtatattctcactgatttgtgggagctaagctatgaggacacaaaggcataagaatcatacaatggactttggggaattggggggaagagtgggaagagggtgagggataaaagacaacaaatatggtgcagtgtatactgcttgggtgatgggtgcaccaggatctcacaaatctccactgaaaaacttactcatgtaaccaatatgccacctgtaccccaataacttatggaaaaataaaattaaaaaataaaaataaaaaagaactcatcaaaaataaaatataaaataaaaatctcccaattaaaaaaaaaaaactttctttgcttaactgaacattcatagctctgagatgctgctgaatattttaatttgaatagtttatttttattgaaattaatagcttattattgaaaagaataataaatacaactttaaagtctatagatatttcctgtgcataaagagaaactgaataccttgtgcctattttcaaagtggatatttctataatgatagcctatttttaaaaaactgattaagttagaatcactaatttagaatatataagtcaggtgagctaaaccatgttaaatatatgtgaaaaaaccacgtcagttgagcactccctgctgctagaatagcgctggggactaaaatattgttgctagaaaggcattagcctcacaatgttctagtctgggcggagctgggggacaacagtgaaggattccactttcacattcgttttaagtttaaaagaaattggtattttaaaattagccgggcatggtggcacacacctgtaatcccaactactccggaggctgaggcaggggaatcccttgaacccgggaggcggaggttgcagtgagctgagatcacatcattgcactccagccttaggcaacaagagtgaaactccatctcaaaacaaaacaaaacaaaaaacaccataggaactggtattttaatatattagaaacaaacaagttttcaacattctcaagcgtttaaaataactaagcagaatgccagttccccacacggcaaccctacttgggtaggccacggggcctggaactcagctggtgattctgggcatcacctgctgcacatcttgggtgagcctgagcttgaagatgtccccactccctttctattctgagcatgtgatcatagtgacaatagtctagcgctcctttctgtgtccttggaagtacagtaatactttatagccacatggtggcagctcccagctccctgtaagctgacaagtgaagaaatgagattgctcatgagataaaagttacttgattgcaagggaggtatgagctacaattacctacccagggtcaaccttctcatgtttttgaggagtgcccccagccacctccagttctcactgttctttttttagtaatgatgattgcatcatgaggcatccccacccggcttggatttctgcgtggacagtggtctggctggccaggcctcatgcccagctgaaaggaggggaacttaggtggacagtgggactgagggaagatgacaaatgcacctgactctgcctacctttggcattttccatatggatcaagtaaacaccagagaagtaaagcgctaggctcaagccttctttcctggctggggaggtgagaaggctggcattcgatgcctcctctgcagaggtgagccagccgcagtgaaaggctgggagagtggcctgttacagaggacaggccttaggctttcccttagtctctctttctgtcaccaacgctaggggaggcagagcctggaagagggagggagcagaggtgtcccaacagcaaagcaccaccatgccttaggatctcagtgctgggttggaaggtgaggaggggctgcccaagcctcccctgcccacacacccacctgggagtccagcccacccagggtggatggaagagattagatttccatcaaggctgacatcgaagttttaagctgggctggttttactgactgacgtgactgggtaatgatgagccccagttgtaactgagggattgaaatggtttggttgaaggctcagattaaggaagaataaaatggctcatgcttatatgtcccctgagtcaagacctttctatattcactaacacaaaaataattttccagccaatacttctgaattcaattcccgtttcttcatagtcacaagaaaagtttaatttctcagaacactcttgagaagggtttttaaaataatcagggaagagttctgcttccagtagtggtgaagtaggttcaactctgccatagacatagcagctattaacataatataaaacagggctgggcgcagtggctcatgtctataatcccagcactttgggaggctgaggcaggtggatcacctgaggtcaggagtttgagaccagcctggccaacatggtgaacccctgtctctactaaaaatacaaaaaaattagccaggtgtggtgacacatggccagctacttgggaggctgaggcaggagaatcgctgaggtggaggttgcagtgagccgaaatcaagccatcgcactccatcctgggcaacaagagtgaaactctgtctctttctctctctctctctctctctctctctctctctctctctctctctctctctctctctctatatatatatatatatatatatatatatatatatatatatatatatatatatatatatagtataaaacagctacccacagtggaggccctggagggtgagcatggcaggcagaagctggaaggatactgatgcctggaataggccacagctgggactgctaggtggctagacggatggacagagtagacacagccaggtggcaactgtctggttatgagagtaagcatgcgggtattcactgtgaagctctttccactttcgtatatgtttgattttttttttttttttttgagacagaatctcactctgtcacctaggctggagtgcaatggcataatctcggctcactgcaacctttgccttccgggttcaagcgattctcctgcctcagcctcctgagtagctgggattacaggcatgtgccatcatgcccagttaatttttgtatttttggtagagatggggtttcaccatgttggccaggctggtctcaaacccctgacctgaggtgatccacctgtctcggcctcccaaagtgctgggattacaggtgtaagccaccgtgcctggcctgaaaaaatttataatgcaatattgggaaaaaaccagaaggtgaatttgactccatcaaggaaaactccatcagcactttacttctctgttgtttacttgatccatatgggaaatgccaaatgcaggtagagtccagtgtgtttgtcatcttccctcagtcctgctgtccacctcggttctcttcctttcagctgggcatggggcctgaccagccagaccactgtccaagcagaagcccaagccaggcggggatgccctcatgatgcattcatcattattaagtgtagttttacccaatacctgatagtgtatctctagttgtaccccaatatcttgtcacatatattaagagctgaagttcattagatttcatattagaataaaataatccatcatttgtgtttctggatttttttcaaggactaagaattttttcaattctgattactaatcacatgggttgatttgagcgtgcatactgaaacttaggttttggtatcttgtcagccactaagagctggccagaaaattatcttggagagattttaatctcttgccccaatttttttaactaatatgtagttgcagatatgcaattagaaaaacaaacaaaaacgctgccagatataacttattgaaggcattttcactttttgcaagtatattccaatgctaatcatactagtggtatgaatcgccatgctctttcttctatcatttatgtttgtaaatcaagcttgttcaacctgtggcccaggacagctttgaaagcggcccaacataaattcataaaatttcttaaaacattataattttttttgcattttttgttttagcttaacagctattgttagtgttagtgtactttatgtgtggcccaagacaattattcttccagtatggcccagggaagccaaaagaatggacacccctgacataaattgtttatgcttctttaggaaaggagaaaatgaaggaaaggaaagtaaaggggaagatttaaacagctgtttttatcttcctgcatcaaaaactgttctgttaaggtgaacatatatactttaaaaaatcagaacatcttcaattaaacttgttaagctatttcaatattatataaattctacaaataaaaagcatttcattccagcatttagaaaactgaaaacaccacgcgagaaaagcaaagacttccttttctttctccttgctttatttaggcagagtatctcaagagatgggtttagaggaaaagcttgctgacagatggtgaacactcttctaatcctggacaaaatgaccaagtgagtgaaaggaaagagacaagggaagtcgagtgagtgttccacacctggagtttgaaaatctaggagtctgaatgtaaggaaaatcagatgaggtggttaggtgatctaagaagcccgaacgcttatattttaagtctttgatccatcctgagttggtttttgtataaggtgacagatagggatccagtttcgttcctttacatgtggcttgccagtttcctgaaacaataaaaattctagaagacaacattggaaaaattcttctagacgctggcttaggcaaagaattcatgactaagacccaaaaagcaaatgcaacaaaaataaaaataaataaatggaacctaattgaactaaaaagcttctgcacagcaaaagaaataatcagcagagtaaacagacaaccccagaatgggaggaaatatttgcaaactacacatctgacaaaaggaatagtatgtagaatctacaagtaacacaaacaaatcagcaagaaaaaactaagtaatctcattaagaagtaggcaaaggacatgagtagacagttctcaaaagaagatacacaaatggccaagaaaaacgtgaaaaaagtgctgaacatcaccaatcatcagggaaatgcaaactaaaaccacagtgagataccaccttaattctgtaaaactgaccattattaaaaactcaagaaacaatagatattgacatggatgtggggaaaaaagaatgcttgtacactgcggatgggaatgtaaatcagtacaacctctatggaaaacatatggagattccttaaggagctaaaagtagatctaccatttgatccagcaatcccactattgggtatctgccctggtacagtttggctgtgcccccagccaaatctcatcttgaattatagtccccataatccccacatgtcatgggagggacctcttgggaggtgattagatcatgggggtggttcgcatgctgttctcctgatagtgagtgagttctcctgagatctgatggttttataaggggcttcccccttcactcagctctcattctccctcctgccgccctgtgaagcggtgccctccgccatgattgtaaggttcctgaggcctcctcagtcatgtggaactgtgagtcagttaaacctcttttctttataaattacccaggcttgggtatttctttatagcagcatgagaacagactaacacatacccaaaggaaaaagaagtcattatatgaaaaagacacttgcacacgtatatttatagcagcacaattcgcaattgtaaagatgtggaaccaacctaagtgcccatcaactgagtggataaagaaaatgtgatatatatgtacacacactcacacacgcacatatatatagtatactgtggaatactactcagccattaaagggagctaaacaatgtcttttgcaaaaccttggatggagctggaggtcattattattattattattattatttgagacagagtcttgctctgtcacccaggctggagtgcagtggcacgatctcagctcactgcagcctctgcatcccgggttccaggattctcctgcctcagcctcctgggtagctgggattacaggcgcatgctaccatgcctggctaatttttgcacttttggtagagacagggtttcgccttgttggccaggcttgtctcgaactcctgacctcattattctaactgaagtaacataggagtggtaaacccaaatctttatgttttcacttagaagtgggagctaagctatgaatatgcaagggcatacagagtgacatatggactttagagactcagtaggggaaagttgggagggaggctggcgataaaaaactgcacatgacgtacaatgtacactactcgggtgacaggtgcactaacatctcagaattcatctctatataatttatccatgtaacaaaaaaccgcttgtaccctaaaagctattgaaaaaaataaataaataaacttcaactccttagcattcacttgtggagcagattttatcagaggccgtgaatcattcatttaggcaacctgttaggtaagcagccagcccagtgcctttaaactacggagaaaatagggctagataagcaaatggcttgcttgagggggagagggcctaccagctactcacccaccataaaggtagtcactcaaacttgcagacttaagtaccaggaaagcagatttctcaaactttaatgtgccaaggattttgttaaaatgcagactttgactcagtaggtctagggaggagctcacatgaaattgtcctcgcttaatgtaatctaaagttaaatatgtgttatttgtttgctctaaaatctcatttaagctagggcaattatttatgactattccatttttaattccatatatattttccagtattattacagtaattccttatacattaaattgctgaagacaaaaatattcaaattgcattttatgaaacagggatctctgtgaagatttttataaattgatgatttatgttacttcattgaggacgattctatgctggatacagtgttttatgatgtgagactgttcaatgaatcaaagagaatcctccacagcacctaactgcatatgataaaccactgtattctctgatggcagagtgaagttaaataaagaacatgctttgggcctgaagtcaaaaagtctttttctctccatttctttttgattccagtaaaaacctttttatttgactagaaggtactcacaggccaaattcactgctatctgaaagggtttggtcgccaccttgtggataataaaacagcaacagcccaaaataatacatttcctgtacaaaaaaaaaaaaaaaaaagattttaaacctccagcgtggttaattttcaaaacatatccaaaaacttactttttaagccactgaacattactgccacaatttggtagactcaaaagaatgcaccctattgtcagagtgaagttagaaagaagagcaaagggcttttgagaatgtttgcagctggagctgctcaaaactgctatctcctaaccaggccacttccttgaaagagatggtactcgtttccggatatgtacataaaggtgcaagttcattacatcacaggttaccttaatttatgcttactgaatttgcatcctgctaccctaattaatcctcaacatggagtagtaagtggaagagcgactcaagaaatgtactgcaatgcttctctgatatatccggtaatgttaacctgtgctttggccacccatgtcgcttagtgttaagacaggagttgtaacagcatttcatcctgggcaattcctttaaataaccagggagaaaataaaggcaagcttcagaagagaactgcatgaaaagcaaaacaaaacaataccagaaaaatccagacaatatttttctgctgtttaattgatctcaaggaaggagaaattcaagtccacaaaaacttacatcaattctgtttatcacatacaaaactaaacatacaatataacagcaaataacaaacatgctgaatattttcaagccattttgaatggtgtcctgtacatgtacataaataatacatactgcttctgaattaccttaaaatacagtaccaccaagagttatatttctatgtaactactccataagtgagcataaaggaatgaggaagtagacgatatccatatcagataaagtagaaagtcttatgtccttctgaaaagcaacacagtaggcccaagaacaactacaaaccattttccttttagctaggaggtatatggcaagaccaatgatattctcttccccatcctttttgtcacagggtatgaagtctatcctattcaagttagttacaagtcttcagcccatttagtcatctaagaagttgagaaagtctaaacctaagtaatcacagcaaatactgcaaatactgatatacttttagttcatttttgtacttttttacattttttccattagataattctaagcctaaaatatttttctttttctttttctttttctttttttttttaaagaaacttggattgttttaattggtttaaatgcagggtatatgtaaacaactccccagaaatgagaggcacttctcggaaatacaataacccatgtcactagactagcaaaacactcagtgcttttgacttgatgaattgaatgagttcatgattcaactttctaatgttgtctacttgaaaaatagcaagattcttatctgcagcatttaatgcattaagatgtattagataggcatatcagatatcataaaattaaaattgtgcttatgttaattctgtaatagacctaactttaaaacacctcatgttattcactaggagctatgatctagtcgtgacaatattggttaaaatagtcaatctgaggcagaaagtaaacaagcaaagtcacttttgcaggctttttaaactgtataacacatgaaattatgactattccccagattatgcaaccagcttcaatttaaaaagctgggaacaaatattatgaggcgttacttctcaatttctttctttttcttttttttttgaaacggagtttccctcttgttgcccaggctggagtgcaatggcacgatcttggctcaccacaacctccgcctcccgggttcaagagattctcgtctcaaacttccgagtagctgggattacaggcatgcaccaccacacccggctaattttgtatttttagtggagacagggtttctccatgttggtcaggctggtcttgaactcccgacctcaggtgatccgcctgcctcggcctcccaaagtgctgggattacaggcgtgagccaccacgcccagccacctctaaatttcttaatcacgattgttttcagctcagacatacacaaggcaagtagaattactaataaatcactttaccctcaaccattcaaggtctctaagagcatgcacatggatacatgacggggaaaggcagcaactcagcataaacactttagtattaacataaggagtatatatacatatacacatatgtatagaatatcttgcttttgaatatctatgggccatgaaacttcatagagagctgcataaaaatctagcagagaaaggatcataagtgaagtgccagccatggataacagactaatctgtgctcacaaaaaagggcaggcaaggaacacacagacatcactcaggaactacaggaaaactaagcgtagtgctgttttccaaatataaaacatatactaagtacaaaagttatagtaaatttgaggactacggaagtaatacttactatatgtacatcttttgttcacataaaaagcttaaagtaagatcttagcataaaagtatgctttctccagtaggatggtgtgagagggaaagaatgtaagaaggaacttgtacaagtctgaaaattaagtcttgaaagtaaaaggctaccataaaaaatattatgtcatttggtatgatcaaaatcagattttaaaagaccttaaaatataacccttgcacattgttttttataattatatacgtataattagagctacataatcttgtctttatgctgtttttgatattttttcagacatttactgctgtctgaaaagtttacaagctattatatgttcccaaatgaaaaatgccaagtttttcatttgcccccaaggtgaaaaaattgaaacctctacgtcaaaaacaaatacagtaattgtttaaagggataaaatcaactataatgacatgggccgtattaaaatacactgcgcaaatatgaacagaaaactcacagcacaactataggaacaagaagatgttatttaactgcagtgaaataagaaggcttggagagagttgggaagcctgaagaccagataagcgagtttagaattcattcagcaaccttactcatattccactctcccgcccctcaccccaagcaaaataataaaatcctgctcttgcaaactgaaacagatcattatttttgactaaggaccacagggtgtggaacccaaatcagtaactttgtaactattacactgaatgtaggtccatgtgttttgatccttttacaggcccttcctttacaaattgtaaagagtgatttccctggggtgcctctctggagaagctttacatgccagcaattccagaatgtcaaatatttcattctcagccccaccaaacagcagtaatcatgctaagcccattgactttggaaaattctgcaagttattttaacctcagttcggagaactcaaaagtaggttttaccaccacctctaagtttaaaatgcccctcaaaaaagaaaaaaaaaaccatgtcagagaaaatgtattaaagtactagattccactgtctctctagaaagcaaccagcttagtgagaaatgactactcaaaatacaaactcactactccctgacttgaggaagaactaaagcttctcctaagggtaaaatgaacagaaattttgcttgaggagtttataaaaaagtaagcgagggagtgggcaagaaggaccttattttaaacatttaggattccacaccatttgaaacagtctgcactatttcatatacttacgtgcatgtgaaaatggggaggtaacaccactagctgctctacacagaccggctactgtagctgaggtttcactgacactttccctggagaggtgccattttattcctttatatggcacatattttacataatttttatctaaagggctctcatttgcctaagactgacaatacaaagaaaggcttattgaaagacacttccctttgaaaataaccccactcagggtagaaataaaggtggacaaaaatgccagtcaactacttaaatgtcagtatttgtaaaattccttaaaattcacagtattttgacttttggaagcgctctaacattgaggtacctgcaggtcttggcaattcagcattttagatatttattttagtttatatgtgttttgctttactccgtttgttttcagttttttctcactcgatacagtggcatgaccacagctctctgcctttccctttttcctaggatgtgcatgtgcttgtgttttggaggccttacaggaatctgctgagtccagaatcacagctgcctgtttgggaactcgaatgtgaccgctggtttccaccttagagctgcttccactgccggacagatcccagcgctgcagcttcgtactcttacttgatttctttttcttttcttctgtcctcatttcaagggtttgcctctgagaacaaaacctggtaccaccaagcacatcaatgggtctaggggaagtctcaaatgcataatgtgatgggtggatttcttcatggtgaaaagctttctttcgggaagggcctgactttgaagccccttcctggtgaggtagtggcttggacagagcactagcaattagcttacttctcccagggcttttcagtgcccctgaggtcccaggggcagtggggggccttgctttgcccccctttgctttttcacactgtacagtctggacttgcagccactcaagctgaataagtctatcgatatacttcccaagaagtcctcccactcggggcacggcttccgttttgttctctgcgttcagaagcagggccatatctcgtaggtcccaggagctgaaaggggatggaaggaaattaggataatagtattcaggttttgtatggccctgaccagggtgaagatcaaagtaaactggatcaatttcttcagctcgaagattgagatctggaggtgtgaggggagaaggaggaatgggaattctttccgaatcagagagatcacttgcactgtcctcatcagcattctctttaataattttcattgactgaaaatcaagaaacagtttattccctgaggccccctgacacctggaaccgagtggattccttttgcgtcttgcttccggggaaatgctttctttaagtttttcttcagtaggctgggtgacagctgtgaggctgcttctcggctgggaagaagcgtggggtacttgggatttactctgcctttttcctgaagaattctttgaatgttgcactttattccaagatgggccagcattcatattgctgtgagaaaataaaactgcaattcttaccacatatgacaaaaaatggtctggctataattaaacaaacaaaaagaatcttctagttgtacttttttttgtctcagctattagtaggcattagaaaatgtcagcttccaaactccttaaagcataagtaattttacagaacattttcccatataatactctatttgagatacattatataatgcatgtgacaaaagagaatgcacagtttccattttatatcaaatattagcatttaggaaaaacattaacatttctcaaagtgcttgtttcatactttcgtgtgtactttaaaaaaaaaacattagtttggaaaaaatcagtcgtagaactctggaattgttaccatcaaaagcatttaataacattcagaagtaaaaacagttttattttatacacctattttaaattaagtgtaaatatcaaataaacatgcaagttttgcagtttaatcactgattggtggcgattctgagctgagtgaaattttaatatataaaagtattgcacatacaaacctgtaccttaaatcaaaagcttgttacaatgttttcaaacagaaaacacatttgggaaaattgtgtttaaagaacagaaataaaatcatatggtgccctgtaacacatatgaatgaaaacacagggtcttagtgttaccttgtgaatagcaggtaaagggaataatgaatactgtgtgcattatgagtatagaaactaattctctctggcataatttattctgatgctgaatctcacatcagagttgaaaatatcctcttttcaatttatttaccaagaacgtggcatttaagattaataatacttctctgtaatataagtcagatagaatgaatagaaatgggtggtaaacatgctttctggaaacttcagaggttcatttgcccagtggtttcaaacaacctaagcaactatttgaatacgtgctacattttaattaataaatatgcaggacattaaatcattgccaatagtacaacgtgtgctcaataaatgttgaataaatgaagaaatgaaggaatctccattattcagaattcataacactgttaaaacattttgttcctgcctgtcagtatgcatccataaaaattaattattgtcactatccttttatataaaaggaaactaacatagaaaagtgattaaaggacttactcaaaattataattctgctaacaactgccagaattatgaccgttggaatccttatccactattatgcttaaaccacttttctattcatttctgctagaaaaaaattataaatgtatatttcttatctatagacatacttttttccccactccacatattcaatctggacaacagagataatgagtcttttgcaagataaagcaattatactaaaactatttacctgcttttctgatgagattcattcaccctattcctcttcttgaaaaaatcacgtggctgatcatcatctcgggtttgatggactgtctaaaaacagggatgcagtaataaacactgtgaacatgtacacaagaaacaagcaagcaaacaaacaaaaatcccagaataaatctaagtcagatttttcttctaagtttacattacctttcctgtagtgctcaaaatattcttgctcaatctgctggaagatgatgacagctggggaggtgacttctttattcctcttatatttggaaaggtctcctcaccaccggaactagaagcaacagaatactgtcagtaactattgattgcaaatggtcctaccaccagtatcgggttggtttttcacttgttttttaatacttgtataatattgaaatattaaggctgtgatcatatagtggtttgcactctaggttatgaaatactggggaagggagacattgtcttatgcttacagctttgtcttttctgcttattacagtagatattagagacaggatcacaggatcacactactataaatactgtgaatggattccatctctctctctctctccctgttcacacacaggtataatcttccttggaaataatatgttgaagaaatctggaaggctaaataaggtcaggtcttattacagcgttcaatcattgcattgcccaatcattcattcatgcaacaaataattacaggagtacccagaaaaatggcaatgattatgcacgtccctgttcagaaggagcttaaactctaggaggaacgttcccattcaatttttcggccttctctatcacatcaatccattataagactttccatatattcatacatattacatattatatatcatctctttatgaagcattgttgacctataccacatattgctgttattcccctctcattttgagtggcctattaaaagtgcactgaatggaaattggatacttctctttcccgtatcacctgtctctgtaaaataaaagagatgattatagaagatttttattttcttcctgaaactttcctgtatttttcccacattaatcatgtaagcctttttagttagcttacatccaatgataaataaaatcattctctcacatttcatgaattataccacaatcaacagccttgactcattttagatgcaacgaatgttcttgaatcaaccccctttcattagtctggttttctttctgctttgtccctctggacaataaaaaggaaccttcttaatggaatggctggccccaaactgctctctggaaagtgcacttgcatcttttctacttcatttcacctggtatgctttacaccaaaggctgtggggttttgtgctcaaagctaccgggtgagagacacgaatgcctgcagggttctaaataggcagaaaacaagctccaggccttgctggtgtttctggcttgcttggaaacaaagctaaaagtcggagattctggctacaaatatgctccccaagcgccagaggctgattaagggcagctgcagaagtcatcagcgggtaataactcttgttcccctgtcttcctctctggcgcggagtccaggaagacaacagcagcacctcccctccccaccctcaagggaatctgctggccattcggtgcggcaaagcattctgggtgatgtggacatgacgctgctcctctacgcagtgaggctccctcggtctgaccaagggtccaggttgcagtgaacctgtccaaagtgtgggctggcctcgatgtttaaaattagcctgagaccagctcctggcaaggccggtttttgcaccaccgctccccccatccacaacccagaaatctaaggacacgcagcatgcattttccttgtcctccgtttgtgcagacaaagtctatgatcgataggcgcgcaatccaggcagacgtaaacagaaattgatcagacctgtttcgcgactgcagcggacacgtgacgaggctgccagccttccttcctctccggcgcccgcgcggggacgcccggctgcggcgcgctgcggcaggggagctggaggcggaggcgcgcagctccgctgagctccctggctgagctgaggccggcgggggcccgcctgcaggcggcgtcacgaggggcggggcggaggctcgctaggaagttgcacccggtcaagttgcagccttgtaagtaacgccgcggaccgggaaagtgggaggggccgctcccggaacgcagccttcttgtaagaacctccaaggaagcaagaagaaaaaagaggcgctaccctgcgctcccgggaggcctctgaaagcttccactagagaaaaactccccactcttacaatttctttaaccgcaagaagcggaggacctggacaaggactcgaggagcaaggtggcgaaccaagggtagggcgcaccgggcccgagaggtcccccgcaggttgcagatacggtggactctctgcggcttctgagcacggagggagctgtcgcggggtcgggaggtcgtctctcatccctgcctcatcttccgacggccggcggggccatgtccagaggcccgagctccgcggtcctgcctagcgccctgggatcccggaagctcggcccccggagcctcagctgcctgtcggacctggacggcggcgtggccctggagccgcgggcctgtaggccccctgggagcccgggccgcgcgccgccgccaacgccagcgccgtcgggctgcgacccccgcctgcggcccatcatcctgcggcgggcgcgctcactgcccagctcccccgagcgccgccagaaggccgcgggcgcgccgggcgctgcgtgtcggccgggctgcagccagaagctccgcgtgcgcttcgccgacgccctgggcttggagctggcacaggtcaaggtgttcaacgcgggagacgacccgtccgtgccgctgcacgtgctgtcgcggctcgcaatcaactcggacctgtgctgcagcagccaggacctggagttcaccctgcattgcctggtgcccgatttcccgccgcccgtcgaggccgccgactttggcgagcgcctgcagcggcagctcgtgtgcctggagcgtgtcacttgctcggaccttggcatcagcggtacggtgcgcgtgtgcaacgtggccttcgagaagcaggtggctgtgcgctacactttctcgggctggcgcagtacccacgaggcggtggcgcggtggcgcgggcccgcaggccccgagggcacggaggacgttttcaccttcggctttccagtaccgcccttcctgctggagctcggctcccgcgtgcacttcgcggtgcgctaccaagtggcgggtgccgagtactgggacaacaacgaccaccgagactacagcctcacatgtcgcaaccacgcgctgcacatgcctcgcggggagtgcgaagagagctggatccacttcatctgagccgcgcggggaccggccacctggagcctccacacctaagctgcgcctcctgtcatttccctgctgggctctcacatctatctggttgttcttcaccaccctccaagtcctctgacctaattttctgctgcaaggtcccctggcagtggcccatcctgtcttctacttgaaacgtctgagtcacttggtctaaaaagtagcctcaggtggccagaaggccgagttgtgtaatgagttggggcagggtggtggggtaggtgcatgggagggtgggccctctggggaggcccaagcagcttgttttgcaaaggcccaagtcctcctgctaggaaaagcttttgcatgtgtcctgaatgtgtctctgtaaacatagctgttatttattattgtgatgttgggacctttagcccatagcggatgcctcctcaggaatattctcgatttaataagctaaaaaaaaaaagttctgtgtttgtgcccacagtaaacagaatgtacagtgtgacccacatcgtggtccctccaggcattcctgccccaggataaggaaaacctgagcccacatctgattgccaacggctgtagccttctaacagtgggaaactattaataggcaagaaatttctgctttatcagtcatcacacaaccattcctgggcattgagactgtcctggttaggctgtgtgtctcctacattaacagctggggaggagggaaaagcttcagacttttaaactagcaaaacagttatttctctgcattcacaattctgatttcatgtatttctctgtacatgtttgatcattatcaggccattctgtttaagtttgaaactaagcattttaagaagtcttgcctcagttatttcagttttcaggtgactagagaatttcaggcaacagtgccctttgcaattacctttttgatgattaaggtgactatttttatttcttgttaagcatcagaagatgtcagcattcatcttttgggagtccagttacaaggtggaactagaaggtgttttcagcaatagccagagcactggaggaaaaataattgacaaatatttatacttttaaattgttttgaactgtatttacatacatcatgttttatcaggtacccaccaactttatactttctgccttcagatagagtttctaacattttctagtttgtcagttttaaaatataaaattcttttatgtttttaaaccgtcaaccaagaagtcaagaccactgtcccctgctgagttaggcaatcacttaaaactccaaagaactccaggctgaggagttcttttggtgctgaacagtggtctgacaacaggtgctagaattaaggtgtgggaaaaaaaaaaaaacagccaggaaggacaagatctccaatttgtgaagcttatgatacagctgaaaccagtctgatcaattttatgctacctgtcaccaagaaattaactctaaatttttgaatgcttgttggcatctgtcaaatcaatactgaaaggatgcatttcggcttttaaccagtttggttctgatcattgcaacctctgtgcttttataattcaaagaacaaggatagctttcttcggtatcttttaatataagaacactgaattttggcttgaaatattgtgactaaattgcacaatctctggctattagcactgttcactacattaacatgcaagagagagagaagccttgttacatttcctgctatttaacaaactgtccaattaggtcagcaagcctgttagggccttcactgctacgcccctggccccaaaacagagagcaagacagttgtccagagaatttagatatgagttaagagctgccagatttattttaaggcatgtagagaatctcataatctatgtgaaagtcacttgccaaaaaggttttggttatgaaagtgaatgttatatatttaatattaagtgaacctcccgtgccttttaaaaaataccaacattatgaaatttaaaagcttaaatatatttgcctagttgataaagaggctgtggaacaactgaaggagaactttcagaccctaaaacagttatattacttagatgttaaaattttctagtgggctgtgcaattgctgggttgtccccccaaacatattttaatatgttatttaaaatgattttacccaagcctaagtattaaagtatatgtgcaaaaacagttgtgagccattctattatgcttcagtatgtttttcttgtggcctaattacagaagaccaagctttagaaacttcttgtctaaatcatttcacatgcaagtcttatcctttctacaacactgataaacgtagagccttggcaaaaataaattttgtcattgtgcctcagcgtcagtagcagagttgttgtatgtgtctttgagaaaaggaaatgcaattttatatgccaggtcagcatgaggtatgaagaaagctctaggggaatacagggaatgtgatcattaatgtacttctcttacaacagttaatgacactgtgcaggcagtaatgagtgtctgtctgtctgccttccggatcgtgaccctcacctaagtacaaagtcttgcacatgggggaagaaaacttacatttattttgtcttcccttatttgcttggccacagtgctaagtgctttaaatatgtgatttcatttaattctgaatgttatgctacctggtagacaatatcccctttttcttagctgaaaataaagctcagagtggtgtaagtacagccataggccacataacatttcactcaacagggtaactgtatatatgacgtggatccatggaattataccagatttttttccgtatcttttctgtgtttagatacacaaatacccttgtgttacagttgtctaccgtattcactgcagtaacatgctgtatacaggtttgcagccttgaagcaatagactgtactatatatacctgaggtgtgtagtaggctataccatctaggtttttgtaagtaaacgctaagatattcacacaataacaaaattgcttgaggaggacacctttctcagaacttacccctatcattaagcaatacataactgtaattcacctaaagtcccatagctggtaagtaacaaattgaacattgaaacctgtttcaaagtcaatgctctctctacctgttatatgacatatagaatattgcaaataaatgcttgttgattcagaaagctaaattaattgaacgccacattatgatatttctcttttttgagagaaggtcttgccttgtcaccaacgttggagtgcagtggtgcaatcatagctcactgcagcctccagctcctgggctcaagcagaattctcctacctcagcctccggcgtagagcagctaggtgcacaggcacatgccaccacgcctggctaattttgtttttttgtagagatagggcctagctatgttgcccaggctagtttcaaattcctggcctcaagcaatcccatcaactcagcctcccaaagtgcagggagtatatgtgtgaaccacggcacatagtttccaaattttgattataattgagaaggtttttcatgaaatgccacggtctaaaacctttaaaaaaaattaacagtaaaattaatgatatcctttttttcttccatgttgtagtttacggatgtttactaaataatccgcaggcttcctgaacacatgaagcaataaaaaagactaacatttttcttcaactaaaaagcggcaaggtaaaaaatcatcactattaatttttgaagtgtattaggaaaatttctgtgcgttcgcaactccaccatgaaggatcttagatctattggcggaaaactaggtatgaaaataattatgcaaaattgccaggtcacaattttgaagcactcttcgatcttcttacattttgtgttatacattattagtacttaaacgtataattcaaaagcattgaaagctttgaacatataaaatcccctcaaatccctgcgtacacctgtgtaccttagattgcatatgtaatctgtcagctctgaattaaaaaactaagatatcaaaattaagttcaatgggggtagttacaaagttgtcaagaagttggtaattctagctaagcagaatatttaaaacacctctgagagcttatttactgtgatttgatctgctctggtccacaactgagctttgattctattaccttgtgtttatttttttcaggtgctttccaccgcacatttaaatcttaatcccatatttttaaacaattagtgccttttagataagaaattaaaatgttattaaaatataattttaaattttgatttgaagatacctataaaagtttaactacacatacaattcaacttttaaaaattgatccgacacaaatattaatccaaaggtggtttgctgcagtattatttgtaatagaagtgtaggctcatcagtggaggattgaattcctcggatgaagttaatccacatgattaaataattacgaagctgttagaaagaccgagctgcatctcagtgcacgtggaacagtttccatctcagaacgcgagcacggggaaaacacgcagaagactgagcgccgaacaccgacgccctctgcgagccaaggggcaaggagaccctttcgcggctgtgcctgtctcagaagggcctgcgattttttacacaagcacccgctggctgcataagttaaacggatctcttaaatggaagcgtctgaaagagcctaggaatacacagttgggtacccagctcagcaccccgtctccggacctgcggtctctcccgccctccggcacccgcacccaggagcccaggcggccctgcgccccctgccggcaggagccaggcctcacccaggagtcgtcggcccggcgccctggtcccccggtccagctcgcccctgcagggctggctggagccgcgggtcccagtggctctggggacgcatagcgcggggatgggcttctcctggtcccgcccgcgcttccgtcccttccatcccttcctgctcgcctgtcccgggaccagggccccagtcaaggcagcgagtctcctcgctggcgggggtgactccgctcgcggggcgttcatcaggagagcatagcgcgagaggacgggccgaagcgcggggacagcggggacccactaacctgagggcctggcctgagccgcgcccacagcgtcccccttggctcaggcctcgggcgaccccggcgagcgttggcgggggtgggggggatggggggggcgggacctggctggcggcgacgccgattggacgcactatcgaccgcacctggcgcggattggacgggcgcttcccgccttccgccgttcgccggaggcgctgcggcggtccctgaggcgcagagttgcgacgctcggcggcatagggggcggctccaccgacactacgcggacgcctcctgccgcaggcaggttgagcagagtgcctgggtgggcttcccccacggcggggcgcggagggagggtggggcttcggcttggcctttcaagccggcaggcgagaagcttccgacggttgaggcggagccgttgtggaagctgccgagggggagggggtgcggttctgcggcagtgggcggaggggaggcgccgaggctgggccagggcgtgggctgtgcagagttcgcggcgagggtggctcgcgcaggcgcgaggctccccatcagcacctgcctggccagcctcggcctcggggatgggaaatgggcgctcggagccgcccccgcgcgtgggcgactcggtcaaggtggctgaggcgcggggcggtgcgcttggcgagcggggagcaggcctggggctgcgcgcgtcgccggcccgaggaggctgaggggtgcgggagaagcggtggcgacgggagccctggggaccgctgctcgcctgtctccgggacatctgaaggggggttggcgctgcggcctggggcgcatctcgggtgtgtgtgtgctttgttggttcgggggtgaccctgggaaaagggtcaccgtgccggcggtgggagcagggacttcgccttcggcctcgttgttgccactgccggttccacttagggaagaagggagtgcgcgcaaaaccttcctcctgctcggcgccttcagtcccttctctccctcccgccgtccccacctgcggcctctccttgcggttgaggccgccagcccctccgcgcagctgggcctgatgcgtcccgcggcggctcaatgcgcgacacgtggctccacgtgcggccttttctggaccgggctccaggctggccgagcatctgcgaatacggcagcgtggtttttttttgttgttttttttcccgagacggagtctcgctctgtcacccaggctggagtttagtggtgcgatctcgcgtcactgcaacctccatcttccgggttccagcgattctcctgcttcagcctccggagtaactgggactacttggcgcgccaccacgcccagctaattttgtatttttagtagagacgggttttctccatgttggcccggctggtctcgaactcctgacctcaggtgatccacctgcctcggcttcccaaagtgctgggattacaggtgtgagccacctcgcccggcctacattttttagtaatgatgggaggaggaggacgccttccctccccttcattcacctttaatgtctttttggacaccttagctatgttagttaccagggcagaggggactttgaattatctactgctgcttgcattcattcagcagtttttcctttgggggaaaatctttgcctcccccatctgccaaattgttttctttgttgttgtttttatccgtaacgcttttatctgcctgcagatacacaatcatcatcttactagttctctgtgttgctcgctaaccagtcccccagttcagtagactggagcccagagcctgcttacttgtcaggtaaatccacgcttctcttgaaacattattattctgttctcggtttccgaagtcgttctgttacatagtagtagttcctaaagatcttttaaattgtttccttatgaggctggaaaaaataagtgtataacttttgtttctttttagagttagccttctctttcacttgcaaatgttaacttgtttgatgttgtggatagtgctgtgcttttgactctattgtggcctgtatgcattcagctttgaggcatgcgtgtgtgtgtgtgtgtaacctgattattcagtttgctttccttggtttgtttttccccaactgacttcgtgcaaaagtagattagaaactaaaaccatcttgttagctttatgtgcctctttggctgtacttttttctgtgctgtaattaatgtctcagggcattttgtaaaatacactgtttcaaattgctttagttctgaaaacagataaagcatagctaatgggcaagcctgcctcaacagttgctggccctagggtaagagtataaatggagcccccacaacatattttaagtatttaaagttttaaatcaagttttcacattgtaaaataaaatagtctcaaatttcacaaatacaccttcactgcatcaaaacagaaaactacatgtatggctatgatgattattattgagacagggtcttgctctgccgccgaggtgggagtgcagtagcgtgaacatggctcactgaaacctggacctcacttcagcctcctgattagctagaccacagctgcgatccaccaggccaggctaacttttatttttgtagaaataggatctcaccatgttgcccatgctggtctggagctcctgggctcaagcagtcctcttgcctgggcctcccacagtgctagccaccagcattacagacataagccaccagccaaggctattatttttatgactgaatcctgaaaagtaccaaagataactgaatgcatttattatggatatctgatgatggactggtaatctttgaataagtgataaaatacttacataattcataagttactatatatagttcatttttattttaaaaatcatgttataatgaagacttttacttatttactattgacagccatgatctaagggttaaaactgtaattactcaaaatgtgttatactcaaaatgtatcaaatttgggtttatatcacaaacataaaataggtgtaaaaagtatttttctttaaaaaattcttaaatattaaaattattgtagaattgtaattgtttccttaaaaaattttaataacaccggaattgcttatttttgaataattgcatattattaaatattataacaatacatttattcactattttagtgtttgcttactgtctaaagagtccatatcatgttcacgtagttcatgtctagatctacatatatattaatatagattgcttactactacagaatgttcctcagccaccatgtgctactgttgcaaatactgtgcactaatttgctagtatttctagagtcacaaattggagtaaaaagagaaggaagaagatgggcatttggcactgttaagaagtagtatcttgtcatgcaagaatcatctgtgttcttgctttgcaggggaaggatttgacaatatctcttttctcttacctaagcacttgctcacatgctatctttgttctgaagcagagactaaaatgttagcattagcacaatctgaaaccttctctgtattcaattgtggcttcacactccccgacttctttaagcattttttttttattattatggaaaattcggacatacgtaaagtaagcagaatagtgtaattaattgcagtcctcttctttcataggcataggcaaaggaagttcaggggcctgaaagatagagttatgagaatgaataatgtgttcatggttatagactttctgggggtagggctgagtcctggattttgagctaatagagatgcctgtgtgctcagtaataagagatagtgagaaagagattacactatatagagcgcatagcaggggccccttttgctctgtcctaatggttgtggtgattgaaagggtatatatgagtgtatgttgaaccttaggaaacagaattaagttaatttaatcaattgtattctcagtctagacaccatgctttactacactcctctaaataaataattaaaattctctttttttttttgtcttttggtccattttattccctatccctagggttattttctttacctgtgcaaatcatccaatgttcatatgcccagtatttgtatccttctttaataaagtatcctctggtgttacacagatatacacatatcaataacagtgcatataagcctttattaagtatactttagattttacataaagaatttctattatctcattctgcattttttatgctttatattgtgtttgagatgcaccatattctgagatacagatcttcttcattatattcagctactgaattcagttgcatcactcaccacatttcatgtttacctcctcacccaacacactgacagaggcagttttcagtttcttgatattagaagaaatgcttcagtaaatatttttatattccctttgtgcttctgagtttctctaaagtgtaaaattagaagtggaactactgtgtcatatggtattcaagtttacatttttacccaatgctatcaaactctttttcaaagtgcagttatttgcttcccaccaggagtacatacatgatttccaatttcctttattcccactgtgacttcgtagtatcagtctctttagtttttgccaatatggtggatggtggagaggggactggttattgttttactagcattctgattaccatggaggtagcattttcatttctttattagccagttgagttttactttctgaatgacctcttcttcttttccatttttgctgttgggttattgcttttttttcctccttgatttgttaagttcttcataataatactttttatgttaatccttagtctcttattccattgcaaatgtcttcctagtatgctgcctctcttttacaaacagtgatgcacaaaaagttaaaatctattactttgtatgttttgtgcatttgttttaaattctttcctcttggaacatcttagtgatagcctcctgaattttctgctaatagtttataaacatttactttttacattcatgtagttaatttatctagaccttatttttttatggcaaaatagatttctaatgttattttttccacatgccaagtcacttttcccagaccatttattgaccagtttacctttcccgatttgcgaaaccatctgactcaaatatgaacttccaatatatgcttatgtgtttgaattctgttttgttttattgatccatttgttttccattcttaatacttcactgtttatagttatttcttgtgactttgtaatatgttttaatatcaaataaggtgatttttcttctctaatattttaaaagttattttagtattagagcagcattattcctccatacatgttttaaaagaattagccaaatctctcaaattattattttgtgatttttactggaattgctttggagtttagaaattcagatgtttattttagtgaagcattgatggttttataatgttaagtccttccattaatgaataggaacaactccatgtattcatatctcttgttaagatctttttgttagatttattcattttagttatttatattaaaaaatgcaattgtctgattattgctaatataaaaaggaacactgtagatatttatgttgagcctcgctggaatctctcaaaggtcctctgataaacagcattcctctttcttcctgggttctgacagagtaggaaaagaaacgtaaccttcattagtcctatattggctaggttcatgggtgtgagtttaggttgttggcctagtgaatttgctaatactgagctccagaattgagcaaacttactgcccaaggcactgcaaggtaattgagttagacctttccagccctgcatttttcaccttccaccctggaagagaaagcttactgtattgactccagaaaaaaaggacagaacaaaatactgactttctcacaggggcagagcttccagaaggaacaaaactgaaaacaacatgaaactcctctttcagttttcatgtaaacaaaagggtgagcctgagctgagcctggctcattttccttcccaaatttaccaatcaaatatttccagctcctcagtggtgatgtaaattaaagaaatagagagaggccgatggtatactcagtctttctcacggaagctaggagtagggaaaaggtatttctctctaacatttcctagctttttgttcacttaattattaacctgttttttggaggagatttatctggatggttcttttcctttcttcatgaggccattaccttcttttgggtattctctttggattgtggaagaactttagatgttgaccctggaagaagattctactttgggttagaacagaaaattgaaacctaatgccactctatatctgaggcagaaatgtcactgttttacttcccattccaaattatctctagatatatggtagagcctttgatgtactatactgaacaaaggtatttggcaatacataaagatgtttcagcagtaaaatgccaacaaatttgaatgtaaagattttctgttttgaacatctcagggaacattaaggttgcaagattaaaaccctttacaagttaaagaccaaggactgaaagatttaagtgtccagaatcctttttttgtgcttctgaatttaaaagtctaaaggccaaaacttttaagtcccaaagacacattctcaacaaatctcattacgttcaagtgcagtcagattctttggtggagttggagttctttcatcagctgtagcttcagctgttttccatggaaaggaagtaccagttatatgttctcagaaactgtttgtccaatgccaaagttctggtatatatttccagtagaccagtctctgtcagttatccagaatctgacttgtttcactttaattgaaatggagaaaatatttcagcaagaggctaattttggcactacatttgaggaaaatttctataattatgtcaccctgtaatggcattgctgccttatgtgcaagggggtaacccaggctgccctggttactagctcttatatgacatgttttccttccccacccagtacattcaaaacctcaacttttatttcttctttgaatcccatgtttttggcattccaatattaagtttgggctttatgtagtgactgttatgggttgaattgtgttcccctaaaaagatatgtgagattctaattcccagtatctcagaatgtgaccttttctggaaatagggtcttttgcatttaaccaagttaagttattaacttattatttaagttattagggtgggccctaacccaatatatatttataaaaaggggaaatttggatacagatatgcatagaagacaatgtgaaaagtaaaaggaagaataccatgtgataaaggaggcagagagtggatttatactgccacaagtcaaagaatgtcggcagctaccagaagcttaaagatccttcttccagcactttcagagggagtatgatcctactgacccctttactttagacgtcttgcctccacactgagataatttctgctgttctaagccatccagtttgtggcactttgttaaggcaaccctaggaaattaatacagtgagagtccacacatagctgtgagcaaacatttttcttcttgttacagaggcagttggcacaattccatcccttatggaatttattggatttatgaaacctgtcttacaggagaaggttcctccttcaatccatatttgttttggctggagactgtctcccagcagattcctgaatggaagctgcttttgttacttctaaagtttgtttccttaatactaggaggtggggttaggaagaattctgagcctatagacaaacataaattcagagctattatttccacagttctctgtgaggttttgacaaactagtgaggttttaaagcaggcagtattgttctgcttcacttcatctaaatgaacactcatgaacttctggttttcttaaaaaaagaaatctaacagattgataataaattatagtacctacatgcatttgggagcagtagtagtcccagtaatcctctgtttgatgaggaaatcttccctctatttaaaacatttaggaatcaaagatgtcaattataaccttgttaccagggcaatacgttaacaagtgaggcaactggtcagagttatagactcttttgaaggtggaaggtcagaggctatgacattaaataggctgaggtgccaaaataggacccttttattcagttcatgtttccaagagtatgtttacattaactgataaccagataacttagtaacagttgtgaatattcacacatgtgaataatgtacaagagaaaaatactttcatctgtgtggcctgccttgttctctcaatgatgttttccaacagagttctttcttttgttaaatcctatgctcatggattgagaaaatcaataggttattttaagttctgggctacatgtgcaagatgtgcaggtttgttgcataggaaaatgtgtgtcatggtggtttgctgcacctatcaacctgtaagtattaaactaagcatgcattagccatttttcctaatgctctccctcctgctgccccaccaggcaccagtgtgtgttgttcccctccctgtatccatgtgttctcattgaacaagagtttctgattttaaggttgtccaacttatcagttgtcttttatggttagagctttttataatcttgcttattgcttattgcaggtcatgaagatgttctaatatattatgttctagaaacttaattgttctcaattttcattccacctggaaatggtgtttgcatatggtatgagatggtatgaagtagtgaggttttgttatatttcttatgaacatccagttgaacagtatagattaattgaaaagattatcttaccctttccttactgctttatgttctaccttgatcataagtcaagtcatgtgtataggtctgtttctggattctcttttcagtaccatctgtgttggacttttatggtaaatccaacagtaatatagttttattagctttcttttgtttgtgtggtagctatcttttctttttatttccaactgttttgtagccctttatttaaggtatatctcttaaaatataatatttttggacagcatatagttttaaaaatgattaacctacccgacaatccaacttttttctttttaatttttgtgggtacatagtaggtgtcaatggagtatgtaagatgttttgatacaggcacgcaatgttaaatgagcacattatggagaatggggtatccatccctcaagcactgatcctttgaggacaatctgccttttaattggagttgtaggggaggcaaaactttacctcttcccttttagagttaaattgacatagacagatcaactggagaaaaacacacaaatttctttaatacatgttttacatgacacaggatccctcataagaacatgaagacccaaagaagtagttagggtcagttatatactgaattggacaaagaatagtaagttgtgaactaagataaggcaaagaggccttaggctagggtagttaattgggtggagaaatgactaggaagataggagtgggtttaacaaagtttggttgtacagattttcttaattttaacttcccctccttaattataagattacttctcttttggtatagagaggacatctttcacatgggaatttcatttcctgcttttaggaaacagaatgaaggtgggagtgatcttgtacctgctgttttttgttgagtgcctttaatttaaaatagtcaatatgtcagagcagcatattgggagggtgacattcttacttcttcagagtatttaatatattttactttcaatgtaattattgatatgtaacttttaatctatcaccttactttgtgttgtctgtttttctttcttcttctgggtctctttctgtttctctctctctctctggattgattaaaatgaaaacattacagcctccctcctcacacttagcttagtagttacgtattctttcactactcatttagtggttaccttagaaatgatgacatgcattctttttgtttattttagagacagagtctccctctcttgactaggctagagtacagtgttgtagtcatagctcactgtaaccttcaacttctaggctcaagcaatttctcaccccagcctccagagtagctgggattacaggcacacaccactatacccagctaattaaaaaaaaatttttttgtagacatggagttttgtaacatacaatatttaaaaaaaaaattcccataattattaaaatgagatggtaagaaacataatcatcagactttattatttataaatgaataatactatcaggcacatggttcctctcagaataaccttagtactttgttccaaaaaagacaggcaaataattatgcatattctacaaaacacaatagggatacagagctttgaggaagactacagcaatgatttgcattttcttgaccaaaataatgttaattccttaggtgttcatggcagggagaatcaatgacgtttatctttgatctttgtcagaaacacacaagataggattgtttgaagtgatttaatctatttttggtcctgttttcataagcatggaatctctctttagaacctggtggatattttctattagccatattgcaatatattaatttgtggcagttatttgtatttgcatcccatggtctttaaggacccagataactttgggaaagtgaggtcctcaccttaatttcagcattcaaccagaaactgggagttctttctttcctgaacactcttgtggacatatgaaatgcatttgagttatcttttcctcactcctttccttgcatattttgatcctgttcattgttagtatatctgcatattcctcctttcttgaatattaatagcccaaatttcatttgcacattaattcaagagtttttttttttccttgttctcagaggtggaacaagtatagcagggaatcactggaaagggagatccaggttattctttcactaactagctttgtgaccttttggcaggatatttgacattaatttaagtaatctataaaaaggaagagcttgactaaatgatcttcaggcttttctctagaaacttatttgatcatattcaaatgtgtaatttaataaacaggtgtttagtgaggaagttaatgttgcctttggtataaataacaaatgcatatttatgtgtgtaagatatttaaactgataaacacatgaaacagattgtgagatacagaaaatatatgttttcttttataggtgtttattttgtcttgctttttttttttttttaaatgaagtcaaaatgccaataagaccagatctccaggtatgtagtcctagaccaaaagtaagtattttcattctgaaaatcactttttgtttacttataggtattcagtgctatgtttttagcaatgataaagcttacatgtttttatgaaatggtcaagaatagtttaaataaagtgtcctttcatgtattcattagatgtttgcaaaagctatgttaagaatatttataaagtattaaaaatgctgattctttatacctaccttttacattgaaaagaattatgcactgattcatgcataatttatgcttggatatttttgtattaagttttagaggttaagatattgtgtatttaggtaaagtgtaagtgttaataatctattcaacatgtatgcagttcacagccaaacctgtttagtgatcaggttgtagtatgaacatttgttattaatgaagttgtactttaatagcaaggatggcagattttaataatgttataaatattatataatggtaatgcttaatttatgttagttggcataatttctaaaaggtgcttttgcctgtctttatgtatttttttctttactatttcaaccccgttaagagattagtagtcaggtatgctaggcttttattcttggtttaagtgttcgttactttaaaatttttttgcttttttcatcaagtttctgttgaggttgacataaagatgaccttagtaataaaagatatgaattggaaatattaataaaatatttttttctaatcatattatcaaagaaatgtaatttctaattcagttgttccaaatttaatagtggccatatttttaaaaaatacgtgaattaatattttatgagttcatttgagagttttcatgtgaaaacggttctcaaattactagattgcataaggtaattaattttggttttgatacagtatgtgccattaaatatatttctctagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggtaaatattcatttttgctgaatgattgttacaattattagatagaactctagttttagaaggaagtactccattagaaaaaaatgaataggcttgggcaagctcagtcataattatataaataaatgcttatttcaccatttgcttattattgtttgtttgtttgaggaatctcaacacattggaatgtcatttcccaaataaaatatacaaaaatatgtgttcacaagggctttactattaactgtggctgaaactggggaaaaaatactttagctctttgaagtttaaacaagttcatagatttttaaaaaaaacctatcagtgtatacttgatgttacataggcaatgcctacttctgtcaaaactaaaacatagaaaaatcaccccaaactttgaatttaatcatatttaaggcattttcatacatgagaaaaggtgattattgataatccccttaccccagtatctgagattcattatgaatccaagaaattgaataaaaatttcttgtttctgttagttaaatacatggagctttttagaatggaaagttgctgattcattgtatcatagtataaagtttcttggatttatacagatttccatttttgtcctgagtttgtcattccctgactgtatggctttgggcaggtcacattcttaaaccacattttcatctgttgcaatatagagatgattaaaatgaccatctttcaggatttgtgaagattaaaatatatgtgtaacactccttgtacaatgtctatttcatactgttttgtgtttacagaaattttaatgtataccttttatttcaggaacttaataaagaggatatccacaatgtttcagccattttggtttctgttggaagatgtggcaaaaatatcagtgtattggggcaagctggacttctaacgatgataaaacaaggactaatacaaaagataagtatagaatatgtaacatattcatgtgaatgaaatattataaaagatatgctttctagtaagaaattatccaaattgttgaaaataaatttaggaactttatgtacaattttgggaataaaacatttctataacttgtgatatatgttacaaatataaagatcacaaactgtacaaagacagactccttggtaatcatgtgagtttaagctccctaaggccttgacttgctttattgtctctttaactcttattatctaacttcattttttgtttttatattgtttgtctgtctcccatgctagcatgtagggtattgatttttgtctctttggttcattgctacattattggcacctagaatagtatctgagatgtatgtactcaaatatctaaattaaggtaaaataatatgaaaacttttcatatagtaacaatatcaaaatggtctaaattgtgatgataatttacttccttctattataataaacgtaccctaactaggaatttgaaggagaaataaggatcttctacatggaatcaaaattaacttcatctattcccattttaaacaatgggaaaagatagttaaaaaaaaacaaggaagatctttaaaaacatgaatttattttgatacaacactaaaattttaattttgatgtgtctttattcctaggtttactgtttatgcaaagatagataagtacattcttaaaattattaaaatggaactctaataagttcattcctttttttacatggttgcctggtttgaaaaatccaaggacattattcagagtcaaggaaattcaaaagatgaagctgttctaaatatgatagaagacttagttgatcttctgctggtaaaaatcacattgattacactgatatttataaagcatgtgtttatttaaaaaacaatttgtgttctctgtgccctgagcctaaaagtcactaacagattggttggtgacttggttggattggtctgttcagattgtataaagcatttattctggtaaatataattaaatggttagttaataaaaagtaattatgctctgagttaaaatgtaatctgtcatttcaataccatttgtaatggtttataatattgtaatggtttgtaatatatagtaacttgtaaattaaatattattcactttttttcaggtcatacatgatgtcagtgatgaaggtataataaacacttattttctattggaacaataaattttactgttagagttttagtataattttacaattcccattgtgttgtcctagtattaagaactcattatctgattcaaggatcaacaaacttttactgtaaagggccagataataaatattttagactttgtagtccaagagaaaaacaattaagaatattatgtagggtacttgtataacaagaaagaaaaacaaatttctatgaataatttattgatgccattgaaaatataatagttgtacaattttttgtaatataggtctactaataatgaaacttgcattctttttgcgagagaataacatttcatttaattagggttcagagttagtgttctgttttcaaaattgattgtaaatgttcatttgttaatccctgtctataatgaggttttatgtatgtcacattagaaaatggcttttcatgcagacaatgccaaatactgatatcagtgcataagcatgcttttaattgagcgtgttcatcacttgaaaggcattaatagaattgttaggttcttaacatttgcattttagaatgtcattgcattgcaaattaatcacttccaattgaaggttatgtggaagcttcccagttgcacaattaaatggattttgaaatgtggaaatttcctttgtacttacaacaaagcccaaaaacactgctagacctgtagttggagtttggaaaaaatatattccctgcaaatttgtgtggaaatggagatgttgcttcctgttttgacagtctgtgaagtgtataaagcagcatagcattgcttgcctttcagatcaccttagttatcagaatgacttcactgcagtgttaagttcatgatgcaagcataattttatcttgtaattttgtgcccagttcatttagaaacattgtcaactctgcagccagtgctaattaccaaagccattcagtattcagcaataaaggttgaggacagctcttgttcagaaaaatttcagtcttggtgctggatatcaaaaagtcacaataaaaccccactgccattggactgctgtgtggtagggaaagtcagaatactcagcttctgcttctgacaaaaattcaaagaactgaccatgggtaaactgacaagagtgaatgatgttcacctttgacactactgttttaataaaacatgatagattcaaatagttttcacagagcacttgctggtgagtaatacagtcatgcaaaaactggcagtgagttgcatttagttcgtgggccatagtttgccaacctttgatctaatggaacaaattttcaatagtaaattgagaatacagaatatgttcctactcattctttgacttgtggcctgcttgtgccaagcaatcagatccaacttattttagctctgtgttgattgaagaagacttacctaggattggtcaatgaggctggtgaattatttataaataaaggtacttgttgtcttcagagccaaaaagttttaaacagattgccattgatttaaataataattaatcctacctcttcgttgattgtttttgctacataacaatgtagtctaaatttttaagtttttagggaaaaaatcctaaagcaccagcaattgtaaagtgatccacctgatttttaaagtaaataattgtatcttttcatctgagtacttttttctttttatgcagtcactttggaaaactgtacatttgttgttacagtatttccattgtttaaagttatttttaaaatttgcattatgaaacagcatgtacacattcctctgaatatacttagtattgataaagcctcatctttcaaaaatgcgttaacgtaaaaggggctcacatcatttagaacttcattggggttaagatgtgttggtctttatgggtataaaaatttttgatgtataactaaaaattaatgaggtcagttttggtaaaagccttagaattgaagttttcaattttgaactatatttacttaatctaaaaaaaaaaataaatacctccttatgtgcctgcagttagaaactagatctagagttgtcccttgacagtattaaaatcagtcacatttgttgagtggtgttttttgcaaggccaagtagaattaggacttaatttcattctttctcatccccaagccctggtgggccttcttctgaactgcagtagtatatcctttccactaactctttatttatttttattttttgagacagggtctcactctcacccaggctggagtacagtggcacgatcacggctcactgcagctttgacctcctgggctcaggtgattctcccacctcagcctcccatgtagctgggattacaggtgcccggctaatttttgtacagacaggattttgccatgttgcccaggctggtctcaaactcctgggctcaagcagtctacctatctgggccttccaaagtgctaggattataggcctgagttaccatgcctggcccctttccactaactcttataagaaaagactgacagttaagaggatttgaaatgaacatttatcaataatttaacacttttattcaggtaaaaaacaagtagtggaaagtttcgtacctcgcatttgttccctggttattgactcaagagtgaatatttgtattcagcaagaggtaaagtcatttatttgtgttttaaaaactaaaaatgagaacgtgaagaaaatcaatagcaattaaattgacaatttatttcatgtaggacaaaattacttagcttggagtatatttctatcataatctattgcctgacatatttccgaaatacttactgaaaatttataaccatatgggtttatgtgtgcatatagctcaagtggaaataaattataccaaccagatttttggggtgcttaagtatttaaatgctaaaaataatctgtattagtatatgtatgtgtgtacatgtactataatcataagaacaaaataaagtaacattttttggcttcctcagatcttataatggagttaaaataaatacaagttttattgcaaaaagtacaagtgctttaagtatcggagtcatgttatattctatttttgatattctatagtttatgttgtttttatattcattattttatactttattatttttatttttttgagagagtcttgctctatctgcctaggctggagtgcagtggcgcaatctcagctcactgcaacctctgcctcccaggttcaagcgcttctcctgcctcccttccgagtagctgggattacaggcacgtgttaccatgcccagctaatttttgtatttttggtagagacggggtttcactatgttggccaggctgatctcgaactcctgacatcaagtgatccgcccgccttggcctcccaaagtgctggtattatagtgagccaccatgcctggcctattttatactttatatattctttcctccatcctactccattcccataataaaactcagtgattaagaaaaaattaggcttctaagtttatgtgcctagaatatttctcttaatagtgtttcactgaatgtaaagttaatgcattatctttttttcttttctagattataaaaaaaatgaatgctatgcttgacaaaatgcctcaagatgcccggaaaatactctctaaccaagaaatgttaattctcatgtaataatctgtacttatatggtttttattcttaaaatccataagaatgttttataagacagacaactatgagtttgcattaataatgaaactgataaactgttgcagctttttaatataatttagtgtatgcatataatttctgcaaaagtcgatgatattagccaattgtaaatttttgtgaagtttcttttcctcctaaacatgtggacttcctatttaattgatactggtctattttgtaatctgttattttaattcacaggagtagtatgggagaaaggattttagatgctggaggtaagtatgtcttttccaaatctaaaattattccatatttatgaatagcagatagtatctttttaatttaaatattagcatagcaatgtgagactgagggaattataaacattatgtacaattaagcaatttttaataaatatacatgaaatttgtctgggacaaaaataatttatgacagtaggcgttagatacatacaatttgtgcctaatggtagacttatgaataatatagcttaatagcttaaattaatagcttaatttaatagcttaatataatagcttaattaataaagcttaaattaatagattaatataatagcttaatataatggcttaatttttcagtagacctgaactacttgtgctaagaaattcctcagatttttttatgaaattagggtgtctaatattcttcatattgatggatttgtttttaaacaatgtgtttattaaaataacttaaaatttattttctaagctttttgtgaatgaattttaatatggtgatttacatgtagaataaatcatggtttaaagtactctgggataactgtaaacatgttacacaagaggaaaacagactttgtaacttacagacaactgtgtgggttactttgcattttatatctctaataataatgaaatggcagtgtctttgaatatttagaagtctcaacatttttttaaattttacttatttcttctgttggcacacttgttatttgggctgtgttaattcctcaaatgatgagatatttctaatccatatgaagaaaatattaatagattaatcaattacattaatatattcttatttctcttgcttattctaataccttgtaaaatatatggtcttttataaacttaattttcataattgtaaatcaaacattaactatttttttaatagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagtaagttgtataacaataacagaaattcgtgaatttttaaaaattattatgatttttaaaagtatttctctttaaaattaggattgcaggatatttctcaaccttgtaaatggcatgcttggagacaaaagaaggtaaacttaatgcaagatacaaccatttactgtcaaataaatagagctcaagagtgagcacccagtgttgcatctttatacatttaactttattcttgttctctacactatgttggagtgtagaatgtgcatagataatttaaaacaataacatgattttagcaaattactacaccagtaatctgaaataattctgcactggccttgttttattttgtactttttagagggaaaagttcatttctgtttaattcatattaattaataactttagatgttcaaaattggcttactatacttctgagttgcatatccattattatttaatgtttgagggataataaaaatctagacatatttattacttgaatcatctccttcatccacatactggaatgtaaatatatagcaaacaaatcatcttcctttataattaacatacagtaagtaggatctttctgaggggcatgaaaggatgtgtaatataaattttaatcttttttttataacgacagaaaaacagaatttgcaatgcctagcacctcatagatgttcaacataattattggatgaatgagttcacatttattttacttactaaagaaattaacggtattgtaagggttgtgcaaggagtcatattacctgatttgaatcataagttcctctcttcctgttctaatattgggcaaattatttaaccttacatgcctcagtttccttagctgttatattaataactacctcatatgtttgtgatatagattaaaatgagataatatgctaactatgtaaaatagtatctaagaaagaattctgtgaatttaaccatttttaatgtaattattcacttgtattcttatttaagttctatggaaacaataagctaagttaggaaactctgctcatatttgatagcacactgtattagtctgttttaatactgctgataaagacatactggagactgagacatttaaaaaagaaagagatttaattggacttaaagttccatgtggctggggaagcctcactatcatggcagaaggcaaggaggagcaagtcccatcttacgtggatagcagcaggcaaagaaagaatgaggaagatgcaaaaggggaaacccctgataaaaccatcagatctcgtgagagttactcactaccgcaagaacagtgtgggagaaactgccctcatgattctgttatctcctaccaggtccctcacacaacacatgggaattatgacagtaccattcaagacgagatttgggtggggacacagaaccaaaccatatcacacacaaaaacatttggtgcaatcattttagtcagaatggtagattgagtagtattgtcaaagtaatatgattttctctacataaatgtccactaaacatgtattttgaaaagtattaaagagggaaatatgattttatttcaattattatgaccactgcctgatttccttttgattctaggcatgatttctattactggacaagattatgctgtgaaagcttatttatttttttcttaaactactttttatttcagggtctttacatttccttgtttatcagcatttcttgataaatatgaggtaaaattttaatttaacacattattttagttattgcatgaattttgatagtcaagtgaattatgagttaaaaatgaataagaacactaaaaatagttgtaattagatcatgaatgtagctggtctagtattctgtatctgacagtgaaaccaggagaagttttatggaacagcatattcattgccaagaataactgaaaaataaaggctgtagtccagtttttctcgtgtttccttaagaccattattgatttatcatgtatgaatctattcaaactagtactttcaacctttattagcacttggaatattcataatttcttggagctagttgattttttataaaatattaaagtagcatttcatttgattgtttttaaatttatctaaatattatacttgtctgttctttctcttctctctccttctagctttgttttcttgctttagccatgaatataacatcataattgtctgttatttctaaaatcattgtatattccagttttgtatgtttattttattagctgcaaataccatcagatgaaaaacttgaggaattttggattgattttaatcttgggagtcagactctctcattctacattgctggagataatgatgtaagtttaatttggttggtattattctttatgtatatgcatatataagatttttacttactttaagaatgtggatttctttatatgttctagccagtctttacctagattttaatattagctctagtagtttgattagcatagcaacctaccaagctaattataaatgaaaactacttctgatgttttattgtataagaaaaaataatgctgagttttaatgctcattttttaacataagcttttaaaaaataaatgttaatttatgacagttaaaattttgtattcacataaacaaagtgaattgactttagaaaagggaagttactcaaatacagtggcattctattgaaaatattaacagacagtgacaagtggacctaacttaatcattcataaaaccttctctttggaaataggacttgagtgggagttaattttagtttttttcttcctatgctttatcatagctgtgctcagatcttccaaataggtggcatattttctgctgacctgcatattttttacctgaggaaaatccttgagccattatttcataatagctaccacctcgtatttgatacatttgcatacatttagctcaaattatgcagtccgtttgccaaaatctgagtaagagttgatcagcatttactaatctggttgtggctggtgatattataataaggctttagtctttttagtctgtttcttatagaatcctgccatttgttccaggtaaacattttatagatgaacattaatcaaatgccttttaggatttccacatgcctttattgctttttattttaaagtaccttcttagaatgcttaaaattgagttccaatgactagcactgcttctcaggggcactgacagtttccattagtatatttctcctgcaggatttgtaggagtgttttaagctgattttttttcgaggagctacttaggcaggtgcaaaagtaattgcggttcttgccattactttcagtggcagaaactgcaattacttttgcaccagcctaatagaatttcgttttgggagaagagaaaagtattgttattaaatagcagtaactactataaaggaaataaatagggcagtgttcctttattcagtttggtctaatggattattgagataagaaaataagcagttaaacatggtgaaaccccgcctctactaaaaatacaaaaataagctgggcgtggtggcaggcgcctgtagtcccagctgctcgggaggttgaggcaggagaatggcgtgaacccaggaagcggagcttgcagtgagccgagatcgggccactgcactccagcctgggcgacagtgggagactgtctcaaaaaaaaaaaaaaaaaaaaaaaaaataagcaattacactatagcagtatacatgatagggaaagtataaaatgcatttataagtatttaatgcctagtgtgttccagacactgatcaagatgctgggggactcttctttccaaaactatatttagaatcctctctcttctgaatttccgtagctgtagtatgttatccctttattctctcttgttctccataaaagccattctccacagtggctccttgaatccttcttctgtctctctgacatggcatacaaggctttttgtggcctggtctctggctgtttctctgatatttcatatattttctatgatgactgtgttccagtcacatttatttttctatttctctaacacagattatgcccatcttaggtctttcttagttcttctgcatagacctcttcctccaggtccttgcatcttagttcttcccatttagatttaagcacaaatgttgccttctcatagagtattctcaggttactcaatataaagtagcctcacaaccacattattccacattgtcttatttcctttatagtagttattatttaaaatcattttgtttatttgttgtttgttgtctgctttcccgcatagagtataagattagtttatagctattcagtggctcatgtttgttggaagaatgagtaaacggaacattgaaagaattgaaagatgtacagagggcataggggattgcaaaaatataggaagtgtggagccaaaggaggattttaagtaggaggtaacatcagttcaatgaatatctattgagaactatgtgtcacgtatgtactaggcactggagaacacatttgtgtaaaagatcccccctggtaggggaaatggataaaaatagactggggagaatggataaaaagaaaaaacactagaggcagttaggaggcttttgcaataatccaggtgagaaataattgtgggatggttttgagatataacgatgggcatggatggaaattgatagaatccagaaagacttgagaggagacagaactgagcaaacttggtgatttgtttgtaattttttaaaaagaaggattactaaaatttgggtagctggatggaagttgagctgtaagtagagatatagaagctatctgtatataaatgacagaaccatgggttttaatgagtgcctatatgaaagaactatgaaaaacaaatttctacaggataagtagaagagattttagccagaaggatacttgaagaatcggccaaaagggaacaaattaaaagggtatagtgttacggacgacaaaggaaaggaggttttatgagaggaaatgatcaacacagtgaaatattcctgagaggggaggttaaataaaaactggtaacccatgaaagagcagtttcacttacatggtgaagagtttaggcattcctagaaagttaaaatatcggttaaggaagtaaagacatcaagttaaggaaagagcgtgacatgtggattcaatgtaggggtttttttgggtatattaaggataagagctttcataaattgatggtgaagggcagatagggagaggttgaaggaaaaaattgaggtcaggaggaaggagtataatggagagtgggaggtgaaaatggaacaaaattgctacaacatactgataactgttgaatctgggtaagggcatattttgggtttataatactatgatttctgattaaaaatctgtttgaaaattgccattatgtgtgtttttttaaaaagtgaactaagtgccttgatatataaggaagaatcagttttaagttggtagatgataacaattattgggaatagagtatgccaactgagatattcctcaaaggagcaagttttttacacacagaaataggaggctgctcaaagccttggggaaaacttagaatactgtccctttcctcctgatcctgaggttttgaggtaagggaaaaaggtggtgatgtcatcagggtgtgactggtttcaattaaggtataggagagaagggaattggtgaaaatagtaaggatttagaggaagttctcgggaatgagttgtccttaaataacaaaagtatttagttttttttcgttttgttttgtgttttgttctgttttgtttgagatggagtctccctctgttgcccaggctggagagcagtggtgcgatcttggctcactgcaagctccgcctcccgggttcacgccattctcctgcctcagcctcctgagtagctggaactacaggcgcccaccaccacgcccggctaatttttttttgtatttttagtagagacggggtttcaccgtgttagccaggatgttctccatctcctgacctcgtgatccgcctgccttggcctcccaaagtcccgggattacaggcgtgagccaccgtgcctggccaggaatggtatttaatttttactataactttgtgaattcagtatcattcagttatacacattttcagtgaaaatacttggggcaaacattttaggttattattcatgcgcattcatatttaaatcaaaggacaatcagttaatgagtattgtggttacaggacctgggataggtagtaggagtgggaattgaggaatgagtatgacttcataaaatatttcaaagaaaacataaaaagacttggtaacatttttaaaaagggtatcctctaataaatataatattaacagtcattcttttttttggttaagaatagaaaattgtcaaaatcatcatttcgttttaataatgaacaaatacattaaatataacatgtgtaatatgtagttaattggtggagcaagaaaggtgttatataaactagttacttagtgactagcaaaaagaattcatagttcctgtaacttgaaatttgatgtttaaagaaactgtaaatcagaaataaattatttatggccaaaacctgcttttaaatttaaggatcatcaatgggaagcagttactgtgccagaggaaaaagtacaaatatacagcattgaaggtattaaacttgtttttttctaataattttcttaattcttaccatatggaacaaatgttacatcctttctgggttaacaaaacagactaatgaaagcaaaatcaatattttcagaggttcacattcagaaattcatcaaacaccttgatcccatgtttccctactaatctcccagctctacccctgtacttacctccttccctgtctagtctaaaaccagtgatccagtttgtcattctggtctctatgtttaaggctcctgaccttccatcccatttgcttgattaaatctgaatatctggtttctccaatcctataactggaactgcataatgctagtggacaaaatcagactagtactattacaaatttagatattaagacatattttatcatttcaatagacatgtaataatatctcatgttttttatttgcatttttccaatgactagtgatgctgagcactttttcatgtgctttctggccattcatatattttcctttgtaaagtatatattttaaatattttgttcattttttattggactatctagttcttaggtatcctagattccactcctttgacatatatatgttctatgttttctccaaaattgtatcttgcttattcattttcttaatgatatctggtgagcagttttaaattttgaaatctacttgatctatttttatggttattgctttccgtgacccaaaaaatttttgtcgactcttaaatcactaagatgttctattatttttccacaaaaattttatagttttagcttttatgtttaggagtattataatctcaaattaatatttgattaaggtatgatgcagagattggaggttcattttttcatatagatatgcagttattacgggattatttgctgtaaaggcttttcttttccattggatttctttggtttctttgttgaaaatcatgactctgtaatagtgtgtctatttcttggtcctccaatctgttctatttatcataggtctacttttctttatgtcagtaccacactgttttgattatggtagatttgtggttagtcttgaagtcagtcagtataagtcttccaacattgtggttttttaaaatattgttttggaaattataggccttttgagcttctatataaattttagaattggtttatcaattgcttgctggaattatgactcaggttttagatcaatatggggagaaataacatgttaacagtcataactagtttataaacatggtgtatctctccatttgtttaggtctttgatttctctcaacagcgtttcatagttttcattgtataagtcttttgatgaatttgttcccaagtattcagtctatatgtttataaatagaattgatctttaattttaccagtcatgggatctgcaaaagaggtagttttactactttctttctgatccttatgcactccctccctcctttccttttgttgctttattgcaatgtatagaacctccagtgcaatgttgaatagaagcgataaaagtggacatctttgcctacttcccaatctttgcttaggaaagaacattcagtattttaccattaagtataatgttagccaaaagtcttttgtagagataaccttcatcagattaaggacgttgataactcttcatatttgtctatgcacatgaaaccatcatggcaattaagttaataaacatatcacccccaaaatttctttgtacttcttttaatctatccatccttgtactctacccccaggcaattactgatgttttctttgatacatttacattttctagagtttatataaatggaatcatacagtacgtagcaatttttgtccagcttctttcttttagaacacttttttaaaaaaagattcaagcatgttgcatgtatcagtagtttattctttttattgctgagtgttagtccattgtatagatatacttcaactggtttctgtagtcacctgttagtgagcatttgtaatgttcccagtttttagctattatgaaatgctgctgtaaatattcatttataattaattacttctgaaaatatgtttttatttctcaggtaaatactaagaagttcagtggttagttcagacccataggcatatgattagcttttgaagaaacttctaaagtgttgtccaaagtgattttaccgttttatattttcactatcagtttataagacttccatttgttctacatcctttctaacacttcttatggtcagtccctcctaccatcttgccttgttgcactggctatataattttcagtacaatgttagtagaaattaaaagagcagacatatttgcttagtttatgatgttggtgttgagggtgaaggggattattttttcttctataattatttcatggtgacaatttctcttgttaattcaggtaagctagttatttatatggcactttcccatctctctcttgctccctctcttgccatgtgatatgcctactccccttttgccttctgcaatgattaaaagcttcctgagtccctcatcagaggcaaatactggcaccatgcttcctgtacagcctgcagaactatgagccaaataaatctttttttataagtttcccaccctcaggtgttccattatagcagactaatacagactaatatagtcttcttctaaaaagatctgttgtttcctctctcgatcagtcatatgttgttgcctctatggatgtcaagtaattttatgatagataatgcatatacaggaacaatagatgctccagataatccttccaccagaagagtttcttttttcttcttaggcagaggggctgaaggactgatc

SEQ ID NO: 36 - DNA, 3318 bp, Homo sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 37 - DNA, 2863 bp, Homo sapiens
atttggagcttggggcagcttctcgcgagagcccgtgctgagggctctgtgaggccccgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggccaaaaaaaa

SEQ ID NO: 38 - DNA, 572 bp, Homo sapiens
acagataaatttgtttttaataaaggagttaattttctttcaatcctatataaaacaatagcaattaaaaacttcatttctgaaagtaaaatatttacatatgaacaagtaactgtgcaaaatttacatgaaaaaatggaaagacagggatttcctaaaagacaaaataaaaggtgtaacagttctcaggtgttgataaaaaatactgatcagcgttcagttcacacacgctcgaattaaagtctaatgtgagaattcacacggagaaagccagagtatttacagtcataaaagtactatcaatagacaatttcatacaataacctctgaaaatagaaagaaccaattagtatatttgtaataaaaaaataggtacaaagaaggggctttgctctggacgtctgtaaagtcggcccaaggcttgcatacagtctcttagcaaaataattatagtttacatagccatttctatgtcatgtgccaaaagttatgtacaattactgacaaaatacaccaaccatttttcaacacttgattcacaccgagaaacagtcttttgatgattcttctca

SEQ ID NO: 39 - DNA, 2474 bp, Homo sapiens
cgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatatgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgttaaaaaaaaaaaaaaaaaaa

SEQ ID NO: 40 - DNA, 1465 bp, Homo sapiens
gaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacatttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctacaaaaaaaaaaaaaaaaaaaaa

SEQ ID NO: 41 - DNA, 4743 bp, Homo sapiens
gggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctactttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacgaaaaaaa

SEQ ID NO: 42 - DNA, 838 bp, Homo sapiens
atcaacaactggtcagttgttttttgttttttcttttccacactgctctctggattcgaacctagtgaattctgggctcagctcctcctccatctctttcttgatccaatccacgtagttgagcactttggttagaagccatacccctcgcacccgagccccaggacacgatgcccgttgccacccagcgatcagtgttcgggtcccttactgcaaaacgcccccactatccccctggcaggcgtcctgctttagagatgggtgtccagcacagaacatgttttgaagaacacatccatcctattcttccccggcgcccagtcctcacagcgcctgtgcgttagctacgggcagacggacaaacctgaggtcatgtcatcttcttcatgaccccgaagccactgacatagcccatcaagcccatggtcgtagaaggatgcgttgtgggggaggcagagggggaggaggttgggacccagggtgacactattttccagctccagcagggcgatgtccccctcaaaattgtaggactcatcctgacggtagtccgggtggacgctgaccctgcggatggggtgatttcctagcttcatgagctcttccacatttgtgtggcccaggaacacatccaaagaggcgttgctttgcgcttcgtgttccttgggatacagggtgtgggcagctgtgaggatccagcggtcgcccagcagggccccgcccccgcgcccgtggatgttggtgaacacctgccaggggaagttgcccatcttgggctttttgccctccgatgatgcgcgcctctgttccacggggttcacgggcttcccacacactg

SEQ ID NO: 43 - DNA, 2582 bp, Homo sapiens
aaaaccaggaaaaggaggctggccggagttcctgcagagggagcgtcaaggccctgtgctgctgtccctgggggccagaggggttgcccagcatgcccactggcaggagagagggaactgacccacttgctcctaccagcttctgaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccaaagggataccttaattcttc

SEQ ID NO: 44 - DNA, 622 bp, Homo sapiens
tagtaagaaaaactttatcaaaaatttaaatatataaaataaggccagagctgcactggaggccacttcccagtggtgcactgctgcgctgggtgtccctatgcagctagatacatgttaactgcatagagtaccataaaggagcccactggtgagcttcactgtcacctggccctgctggctggggcttccattgtctactgggtctgtccacaccccagattgccttgtggtcctttcccctggccaagaagataacagttttttaaaaatccccttctgatatggatgtgagcaagcagtggggttcagtttgggaccaagcagtgccatttacaaagagcatgggaagcacctccttaggaggggaagcagggccatctccacgttgtcaggggccgcgccgtttgcctgccagaccctgggcccacttgtgcaggcggctgtagagtggggagccctgggttctcacggtacagtagacgccggtgatggcattccactgtggccgtggtgcgtgccttccactggggagttggcaatcagttcccatcatcctgttgagcgccaaagcctcgtgccgattcttggctcgaggccaattcccatagtggtcgtataa

SEQ ID NO: 45 - DNA, 1825 bp, Homo sapiens
acacatgctgcatacacacagaaacactgcaaatccactgcctccttccctcctccctacccttccttctctcagcatttctatccccgcctcctcctcttacccaaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcaaaaaaaaaaaaaaaa

SEQ ID NO: 46 - DNA, 1080 bp, Homo sapiens
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 47 - DNA, 850 bp, Homo sapiens
cgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcggaaaaaaaaaaaaaaaaaaaaa

SEQ ID NO: 48 - DNA, 4150 bp, Homo sapiens
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgaaaaaaaaaaaa

SEQ ID NO: 49 - DNA, 583 bp, Homo sapiens
taccatatgcttatgtttattgtacagtcacaagttacatgttgtaaatcaagcagaacactgtaccagttttcactaactcaaatcaagttagcaaattacaaattttagaacagattcattttctgtctcacccaatgtgggtgaccacaaagatatttactttctatgttattaggtagcaaattaatttgatatactacacagcttccaagttaccttaggatatttcaaagtgtttcaaaactggtaaagaataattcatttccagcctgaaatacaatgcagaatggaccatttaggggtaaataacctcacttaatcactctttcctgctaacaaaaataatacaaatatttgtttatattaggcctactaaattaatgacaactttgaaattatctagatttggttacattgttatattgcacttgagaacaatgacaaaaaacatcaaagattcagtacctctcccaagaagttcattatatatcagaattaaaatgaaatataagcatatattgcatgctgcatatttctatcgttcaaaccagccaaccaacaaactaaaaggaatactctc

SEQ ID NO: 50 - DNA, 2779 bp, Homo sapiens
aaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaagctttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgggcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtc

SEQ ID NO: 51 - DNA, 3549 bp, Homo sapiens
acatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaaaaaaaaaaaaaaaaaaaaaaaaa

SEQ ID NO: 52 - DNA, 1007 bp, Homo sapiens
gcagtctccgattccccatcaccaattcggctggggcgccctgcaagccgcacggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcaaaaaaaaaaaaaaaaaaaaaaaaaaaaa

SEQ ID NO: 53 - DNA, 798 bp, Homo sapiens
gggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggcagcagggatggggttggggaggttctcccaaccccactttcttccttccccagctcactaaattccctcctgcttaaaaaaaaaaataaccaaacaaaaaaaaaacaaaaaaaaacacgggggttttttgggggggaaaaaagagattaaagggccggaaattttctcagccctttttaaaagggggtt

SEQ ID NO: 54 - DNA, 580 bp, Homo sapiens
tagaattatggaaaatttttatttccttcttttggcttctaaattttatataatgagcatattgggcttggtataatcatttttaaaaagtggttttagaagaatagtactgatatatcattcccttttagcagttttctctaggataaaaaataagaggaagtctgagcttaactaattaaaaaaacagatttctttaaaaaatattagcaaatcattaatgttcttacgggagaaagggcagtgttcaaagaagaattaaacaaatcattccagtggcaggaaaaattcaatttactggcatgcagacggtttctggactggaaaagttaatccctttcattcagaatcagtatgcatattcactggctatatttcatctcacatctggcaaacttaatttttcctttctgtggtcatcagaagattaggaaataaattttagtccaggcaatagatcctactgtggcaagctcaaaataactcaattattaaaaagcagcacacaaagaccagtagtgactccaaaaggatggttaacaatacttaaaaaaacaaacacacggaaacagggaaaaaa

SEQ ID NO: 55 - DNA, 557 bp, Homo sapiens
ggaaaagtttggaagaggcagagaaatcctgctctcctcgccttccagcagcttcctgtaggtggcaatctcaatgtcaagggccatcttaacattgagcaggtcttggtattcacgaaggtgacgagccatttcctccttcatattctgaatctcatcctgcaggcggccaatagtgtcttggtagttagcagcttcaacggcaaagttctcttccatttcacgcatctggcgttccagggactcattggttcctttaagggcatccacttcacaggtgagggactgcacctgtctccagtactcagtggactcctgctttgcctggcgcaaggcgtcaattgtcctgttggcagcctcagagaggtcagtcaacttggatttgtaccattcttctcgctactgcagttcttgacgagcacacttcatatagctgacgtacgtcacgcagggcacgcgtgacgtcaggcttggacacatgcacatcgatctggacatgctgtactgaatctgagcctgcagcttctggattgcctcttcgtgagttcgtcaaaaag

SEQ ID NO: 56 - DNA, 564 bp, Homo sapiens
atgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatg

SEQ ID NO: 57 - DNA, 21 bp, Artificial Sequence
  Synthetic oligonucleotide, forward primer for KRAS exon 2
cgatacacgtctgcagtcaac

SEQ ID NO: 58 - DNA, 20 bp, Artificial Sequence
  Synthetic oligonucleotide, reverse primer for KRAS exon 2
accctgacatactcccaagg

SEQ ID NO: 59 - DNA, 20 bp, Artificial Sequence
  Synthetic oligonucleotide, forward primer for KRAS exon 3
aggtgcttagtggccatttg

SEQ ID NO: 60 - DNA, 20 bp, Artificial Sequence
  Synthetic oligonucleotide, reverse primer for KRAS exon 3
tgcatggcattagcaaagac

The invention claimed is:

1. A method for supporting a diagnosis of a risk of colorectal cancer recurrence, comprising the steps of:
    performing a first measurement to measure levels of expression of all of the following genes in a first gene group: C18orf22, C18orf55, CCDC68, CNDP2, CYB5A, LOC400657, LOC440498, MBD2, MBP, MYO5B, NARS, PQLC1, RTTN, SEC11C, SOCS6, TNFRSF11A, TXNL1, TXNL4A, VPS4B, and ZNF407; a second measurement to measure levels of expression of all of the following genes in a second gene group: ASXL1, C20orf112, C20orf177, CHMP4B, COMMD7, CPNE1, DIDO1, DNAJC5, KIF3B, NCOA6, PHF20, PIGU, PLAGL2, POFUT1, PPP1R3D, PTPN1, RBM39, TAF4, and TCFL5; and a third measurement to measure levels of expression of all of the following genes in a third gene group: ANGPTL2, AXL, C1R, C1S, CALHM2, CTSK, DCN, EMP3, GREM1, ITGAV, KLHL5, MMP2, RAB34, SELM, SRGAP2P1, and VIM, in a biological sample collected from a patient with colorectal cancer,
    wherein the levels of expression of the genes are measured with a microarray in said first, second and third measurements; and
    determining the risk of colorectal cancer recurrence of the patient based on results of the first measurement, second measurement and third measurement, wherein said determining comprises making a determination that:
    the patient is at high risk for colorectal cancer recurrence when up-regulated expression of genes belonging to the third gene group is detected,
    the patient is at medium risk for colorectal cancer recurrence when down-regulated expression of genes belonging to the first gene group, and down-regulated expression of genes belonging to the third gene group, is detected,
    the patient is at medium risk for colorectal cancer recurrence when up-regulated expression of genes belonging to the first gene group, and down-regulated expression of genes belonging to the third gene group, is detected, or
    the patient is at low risk for colorectal cancer recurrence when up-regulated expression of genes belonging to the first gene group, down-regulated expression of genes belonging to the second gene group, and down-regulated expression of genes belonging to the third gene group, is detected.

2. The method according to claim 1, wherein
    in the determination step,
    classifying the risk of recurrence for the biological sample into the risk group having the highest correlation based on:
    the levels of expression measured in the measurement step,
    the levels of expression in a high-risk group measured in advance for biological samples of a patient group determined to have a high risk of recurrence,
    the levels of expression in a medium-risk group measured in advance for biological samples of a patient group determined to have a medium risk of recurrence, and
    the levels of expression in a low-risk group measured in advance for biological samples of a patient group determined to have a low risk of recurrence.

3. The method according to claim 2, wherein
    in the determination step,
    a correlation coefficient between the levels of expression measured in the measurement step and the levels of expression in the high-risk group is calculated,
    a correlation coefficient between the levels of expression measured in the measurement step and the levels of expression in the medium-risk group is calculated,
    a correlation coefficient between the levels of expression measured in the measurement step and the levels of expression in the low-risk group is calculated, and
    the risk of recurrence for the biological sample is classified into the risk group having the highest correlation coefficient.

4. The method according to claim 2, wherein
    in the determination step,
    cluster analysis is conducted based on the levels of expression measured in the measurement step, the levels of expression in the high-risk group, the levels of expression in the medium-risk group, and the levels of expression in the low-risk group, and then the risk of recurrence for the biological sample is classified into the risk group having the highest correlation.

5. The method according to claim 1, wherein in the determination step
    the risk of recurrence is determined to be high when the levels of expression of genes selected from the third gene group are more than or equal to the standard values of the genes regardless of the levels of expression of genes selected from the first and second gene groups;
    the risk of recurrence is determined to be medium when the levels of expression of genes selected from the third gene group are lower than the standard values of the genes and the levels of expression of genes selected from the first gene group are lower than the standard values of the genes regardless of the levels of expression of genes selected from the second gene group;
    the risk of recurrence is determined to be medium when the levels of expression of genes selected from the third gene group are lower than the standard values of the genes, the levels of expression of genes selected from the first group are more than or equal to the standard values of the genes, and the levels of expression of genes selected from the second gene group are more than or equal to the standard values of the genes; and
    the risk of recurrence is determined to be low when the levels of expression of genes selected from the third gene group are lower than the standard values of the genes, the levels of expression of genes selected from the first gene group are more than or equal to the standard values of the genes, and the levels of expression of genes selected from the second gene group are lower than the standard values of the genes.

6. The method according to claim 1, wherein the risk of recurrence is determined to be high when a group determined to have a medium risk of recurrence has a KRAS gene mutation, and the risk of recurrence is determined to be low when the group determined to have a medium risk of recurrence does not have the KRAS gene mutation.

7. The method according to claim 1, wherein the biological sample is a biological sample collected from colorectal cancer patient without receiving adjuvant chemotherapy.

8. The method according to claim 1, wherein the biological sample is a biological sample collected from patient with colorectal cancer in stage II or stage III.

9. The method according to claim 1, wherein
the biological sample is a biological sample collected from patient with colorectal cancer in stage II, and
when the biological sample collected from the patient with colorectal cancer in stage II is determined as a high-risk group in the determination step, an anticancer drug is administered.

10. The method according to claim 2, wherein
the biological sample is a biological sample collected from patient with colorectal cancer in stage II, and
when the biological sample collected from the patient with colorectal cancer in stage II is determined as a high-risk group in the determination step, an anticancer drug is administered.

11. The method according to claim 1, wherein
the biological sample is a biological sample collected from patient with colorectal cancer in stage III, and
when the biological sample collected from patient with colorectal cancer in stage III is determined as a low-risk group in the determination step, an anticancer drug is not administered.

12. The method according to claim 2, wherein
the biological sample is a biological sample collected from patient with colorectal cancer in stage III, and
when the biological sample collected from patient with colorectal cancer in stage III is determined as a low-risk group in the determination step, an anticancer drug is not administered.

13. A method for treatment of colorectal cancer, comprising the steps of:
performing a first measurement to measure levels of expression of all of the following genes in a first gene group: C18orf22, C18orf55, CCDC68, CNDP2, CYB5A, LOC400657, LOC440498, MBD2, MBP, MYO5B, NARS, PQLC1, RTTN, SEC11C, SOCS6, TNFRSF11A, TXNL1, TXNL4A, VPS4B, and ZNF407; a second measurement to measure levels of expression of all of the following genes in a second gene group: ASXL1, C20orf112, C20orf177, CHMP4B, COMMD7, CPNE1, DIDO1, DNAJC5, KIF3B, NCOA6, PHF20, PIGU, PLAGL2, POFUT1, PPP1R3D, PTPN1, RBM39, TAF4, and TCFL5; and a third measurement to measure levels of expression of all of the following genes in a third gene group: ANGPTL2, AXL, C1R, C1S, CALHM2, CTSK, DCN, EMP3, GREM1, ITGAV, KLHL5, MMP2, RAB34, SELM, SRGAP2P1, and VIM, in a biological sample collected from a patient with colorectal cancer;
determining the risk of colorectal cancer recurrence of the patient based on results of the first measurement, second measurement and third measurement, wherein said determining comprises making a determination that:
the patient is at high risk for colorectal cancer recurrence when up-regulated expression of genes belonging to the third gene group is detected,
the patient is at medium risk for colorectal cancer recurrence when down-regulated expression of genes belonging to the first gene group, and down-regulated expression of genes belonging to the third gene group, is detected,
the patient is at medium risk for colorectal cancer recurrence when up-regulated expression of genes belonging to the first gene group, and down-regulated expression of genes belonging to the third gene group, is detected, or
the patient is at low risk for colorectal cancer recurrence when up-regulated expression of genes belonging to the first gene group, down-regulated expression of genes belonging to the second gene group, and down-regulated expression of genes belonging to the third gene group, is detected; and
treating the patient with an anticancer drug when the biological sample collected from the patient with colorectal cancer is determined as a high-risk group in the determination step.

14. A method for administration of an anticancer drug, comprising the steps of:
performing a first measurement to measure levels of expression of all of the following genes in a first gene group: C18orf22, C18orf55, CCDC68, CNDP2, CYB5A, LOC400657, LOC440498, MBD2, MBP, MYO5B, NARS, PQLC1, RTTN, SEC11C, SOCS6, TNFRSF11A, TXNL1, TXNL4A, VPS4B, and ZNF407; a second measurement to measure levels of expression of all of the following genes in a second gene group: ASXL1, C20orf112, C20orf177, CHMP4B, COMMD7, CPNE1, DIDO1, DNAJC5, KIF3B, NCOA6, PHF20, PIGU, PLAGL2, POFUT1, PPP1R3D, PTPN1, RBM39, TAF4, and TCFL5; and a third measurement to measure levels of expression of all of the following genes in a third gene group: ANGPTL2, AXL, C1R, C1S, CALHM2, CTSK, DCN, EMP3, GREM1, ITGAV, KLHL5, MMP2, RAB34, SELM, SRGAP2P1, and VIM, in a biological sample collected from a patient with colorectal cancer;
determining the risk of colorectal cancer recurrence of the patient based on results of the first measurement, second measurement and third measurement, wherein said determining comprises making a determination that:
the patient is at high risk for colorectal cancer recurrence when up-regulated expression of genes belonging to the third gene group is detected,
the patient is at medium risk for colorectal cancer recurrence when down-regulated expression of genes belonging to the first gene group, and down-regulated expression of genes belonging to the third gene group, is detected,
the patient is at medium risk for colorectal cancer recurrence when up-regulated expression of genes belonging to the first gene group, and down-regulated expression of genes belonging to the third gene group, is detected, or
the patient is at low risk for colorectal cancer recurrence when up-regulated expression of genes belonging to the first gene group, down-regulated expression of genes belonging to the second gene group, and down-regulated expression of genes belonging to the third gene group, is detected; and
administering the anticancer drug to the patient when the biological sample collected from the patient with colorectal cancer is determined as a high-risk group in the determination step.

15. The method according to claim 13, wherein the anticancer drug is at least one selected from the group consisting of 5-fluorouracil and oxaliplatin.

16. The method according to claim 14, wherein the anticancer drug is at least one selected from the group consisting of 5-fluorouracil and oxaliplatin.

* * * * *